United States Patent 11,931,406 (FLAVIVIRUS VACCINE) - sequence listing, part 28

SEQ ID NO: 11614 - RNA, 9879 nt, Artificial Sequence
  derived and/or modified CDS sequence (opt2) from DENV-1__HQ332182__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcaccucccacaacauccucgucgagguccaggacgacggcaccaugcgcaucaaggacgaggagaaggacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagcgcgaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcgccucccagguccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccgucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11615 - RNA, 9879 nt, Artificial Sequence
  derived and/or modified CDS sequence (opt2) from DENV-1__HQ332181__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucguccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcaccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccgcccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacaacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgacuccgagggcgcccucugguga

SEQ ID NO: 11616 - RNA, 9879 nt, Artificial Sequence
  derived and/or modified CDS sequence (opt2) from DENV-1__HQ332180__SS-prME
uccgucaccaugcuccucaugcuccuccccaccgcccucgccuuccaccucaccacccgcggcggcgagccccacaugaucaucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgccaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccacccaccucgcccucauggccaccuucaagaugcgccccauguucgccgucggccuccucuuccgccgccucaccucccgcgagguccuccuccucaccaucggccucucccucauggccuccauggagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugauccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcucaagggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11617 - RNA, 9879 nt, Artificial Sequence
  derived and/or modified CDS sequence (opt2) from DENV-1__HQ332179__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccuccuccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccugcgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcucaagggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11618 - RNA, 9879 nt, Artificial Sequence
  derived and/or modified CDS sequence (opt2) from DENV-1__KR919820__SS-prME
accgucgucgcccuccucaugcuccuccccauggucuucuccuuccaccucaccacccgcggcggcgagccccacaugaucgucaacaagcaggagcgcggcaagucccuccucuucaagaccuccggcggcaucaacaugugcacccucaucgccauggaccucggcgaccucugcgaggacaccaugaccuacaagugcccccgcaucaccgaggccgagcccgacgacgucgacugcuggugcaacgccaccgacaccugggucaccuacggcaucugcucccccaccggcgagcaccgccgcgagaagcgcuccgucgcccucgccccccacgucggccucggccucgagacccgcgccgagaccuggauguccuccgagggcgccuggaagcagauccagcgcgucgagaccugggcccuccgccaccccggcuucaccgucaucgcccucuuccucgcccacaucaucggcaccuccaucacccagaagggcgucaucuucauccuccucaugcucgucacccccuccauggccaugcgcugcgucggcgucggcaaccgcgacuucgucgagggccucuccggcgccaccugggucgacgucguccucgagcacggcuccugcgucaccaccauggccaagaacaagcccacccucgacaucgagcuccucaagaccgaggucuccaaccccgccguccuccgcaagcucugcaucgaggcccgcaucuccaacaccaccaccgacucccgcugccccacccagggcgaggccucccucuccgaggagcaggacaccaacuucgucugccgccgcacccucgucgaccgcggcuggggcaacggcugcggccucuucggcaagggcucccucaucaccugcgccaaguucgagugccucaccaagauggagggcaagaucguccaguacgagaaccucaaguacuccgucaucgucaccguccacaccggcgaccagcaccaggucggcaacgagaccaccggccacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccugggccuccggcgccuccuccccccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucaagaaggaggucgccgagacccagcacggcaccguccucguccaggucgaguacgagggcaccgacgcccccugcaagauccccuucaccacccaggacgagaagggcgucauccagaacggccgccucaucaccgccaaccccaucgucaccgacaaggagaagcccgucaacaucgaggccgagccccccuucggcgaguccuacauggucaucggcgucggcgacaaggcccucaagcucuccugguucaagaagggcuccucccucggcaagauguucgaggccaccgcccgcggcgcccgccgcauggccauccucggcgacaccgccugggacuucggcuccgucggcggcgucuucaccuccaugggcaagcucguccaccagaucuucggcaccgccuacggcguccucuucuccggcgucuccuggaccaugaagaucggcaucggccuccuccucaccuggcucggccucaacucccgcuccaccucccucuccaugaccugcaucgccgucggcaucaucacccucuaccucggcgucaugguccaggccgacaccggcugcgucgucaacuggaagggccgcgagcucaagugcggcuccggcaucuucgucaccaacgagguccacaccuggaccgagcaguacaaguuccaggccgacucccccaagcgccucuccgccgccaucggcaaggccugggaggacggcgucugcggcauccgcuccgccacccgccucgagaacaucauguggaagcagaucgccaacgagcucaacuacauccuccucgagaacgacaugaaguucaccgucgucgucggcgacgucaagggcauccucacccagggcaagaagggcauccgcccccagcccauggagcacaaguacuccuggaaguccuggggcaaggccaagaucaucggcgccgacguccagaacaccaccuucaucaucgacggccccgacacccccgagugccccgacucccagcgcgccuggaacaucugggaggucgaggacuacggcuucggcaucuucaccaccaacaucuggcucaagcuccgcgacuccuacacccaggucugcgaccaccgccucauguccgccgccaucaaggacucccgcgccguccacgccgacaugggcuacuggaucgaguccgagaagaacgagaccuggaagcucucccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcagugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcaaggucgacaacuucucccucggccuccucugcaucuccaucauggucgaggaggucaugcgcucccgcugguccggcaagaugcucaugaccggcaccauggccgucuuccuccuccucgucaugggccagcucaccuggaacgaccucauccgcgucugcaucauggucggcgcccacgcccucgacuccaugggcaugggcaccaccuaccucgcccucauggccaccuucaagauccgccccaugcucgccgucggccuccucuuccgcaagcucaccucccgcgagauccuccuccucaccaucggccucucccucaucacccccgucgagcuccccaacuccaucgaggagcucggcgacggccucgccaugggcaucaugaugcucaagcuccucaccgacuuccagcccuaccagcucugggccacccuccucucccucaccuucgucaagaccacccucucccuccacuacgccuggaagaccgccgccaugguccucuccaucgucucccuccucccccucugccucuccaccaccucccagaagaccaccuggcuccccauccuccucggcucccucggcugcaagccccucaccauguuccucaucuccgagaacaagaucuggggccgccgcuccuggcccaucaacgagggcaucauggccgucggcaucgucuccauccucauguccucccuccucaagaacgacgucccccucgccggcccccucaucgccggcggcaugcucgucgccugcuacgucaucuccggcuccuccgccgaccucacccucgagaagaccgccgaggucuccugggaggaggaggccgagcacuccggcaccgcccacaacauccucgucgagguccaggacgacggcaccaugaagaucaaggacgaggagcgcgaggacacccucaccauccuccucaaggccgcccuccucgcccucuccggcgucuaccccauguccauccccgccacccucuucgucugguacuucuggcagaagaagaagcagcgcuccggcguccucugggacauccccuccccccccgaggucgagaaggccguccucgacgacggcaucuaccgcauccuccagcgcggcgucuucggccgcucccaggucggcgucggcgucuuccaggagggcgucuuccacaccauguggcacgucacccgcggcgccguccucaccuaccagggcaagcgccucgagcccuccugggccuccgucaagaaggaccucaucuccuacggcggcggcuggcgccuccagggcuccuggaacgucggcgaggagguccaggucaucgccgucgagcccggcaagaaccccaagaacguccagaccguccccggcaccuucaagacccacgagggcgaggucggcgccaucgcccucgacuucaagcccggcaccuccggcucccccaucgucaaccgcgacggcaaggucgucggccucuacggcaacggcgucgucaccaccuccggcaccuacgucuccgccaucgcccaguccaaggucucccaggagggcccccuccccgagaucgaggacgaggucuucaagaagaagaaccucaccaucauggaccuccaccccggcuccggcaagacccgccgcuaccuccccgccaucguccgcgaguccaucaagcgccgccuccgcacccucauccucgcccccacccgcgucgucgccuccgagauggccgaggcccucaagggccuccccauccgcuaccagaccaccgccguccgcaacgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgccgaggccuucccccaguccaacuccgucaucuacgacgaggagaaggacauccccgagcgcuccuggaacuccggcuacgacuggaucaccgacuuccagggcaagaccgucugguucguccccuccaucaagaccggcaacgacaucgccaacugccuccgcaagaacggcaagcgcgucauccagcucucccgcaagaccuucgacaccgaguaccagaagaccaagaacuccgacugggacuucgucgucaccaccgacaucuccgagaugggcgccaacuuccgcgccgaccgcgucaucgacccccgccgcugccucaagcccgucauccuccgcgacggccccgagcgcgucauccucgccggccccaugcccgucaccgucgccuccgccgcccagcgccgcggccgcaucggccgcaaccaguccaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcauccaguacgccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccaccaccucacccagcgcgcccagaacgcccucgacaaccucgucaugcuccacaacuccgagcagggcggccgcgccuaccgccacgccauggaggagcuccccgacaccaucgagacccucaugcuccucgccaugaucgccacccucaccggcggcgucgcccucuucuuccucuccggcaagggccucggcaagaccuccaucggccuccucugcgucauggccuccuccacccuccucuggauggccuccgucgagccccacuggaucgccgccuccaucguccucgaguucuuccucaugguccuccucauccccgagcccgaccgccagcgcaccccccaggacaaccagcucgccuacgucgucaucggccuccucguccucauccucaccgucgccgccaacgagaugggccuccucgagaccaccaagaaggaccucggcaucggcuccgccgccgccgagauccagcaccacaccaccauccucgacgucgaccuccaccccgccuccgccuggacccucuacgccgucgccaccaccgucaucacccccaugcuccgccacaccaucgagaacaccaccgccaacaugucccucaccgccaucgccaaccaggccgccauccucaugggccucgacaagggcuggcccaucuccaagauggacaucggcgucccccuccucgcccucggcugcuacucccaggucaaccccaugacccucaccgccgccguccucaugcucgucgcccacuacgccaucaucggccccggccuccaggccaaggccacccgcgacgcccagaagcgcaccgccgccggcaucaugaagaaccccaccgucgacggcaucgucgccaucgaccucgaccccgucgucuacgacaccaaguucgagaagcagcucggccagaucaugcuccucauccucugcaccucccagauccuccucaugcgcaccaccugggccuucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcaaccgccgcggcaccggcgcccagggcgagacccucggcgagaaguggaagcgccagcucaaccagcucuccaagcucgaguucaacaccuacaagcgcuccggcaucauggaggucgaccgcaccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagguccucaaccccuacaugcccuccgucgucgagacccucgagcgcaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccaugacccaccgcaagcccaccuacgagaaggacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccaggucauggagaucaccgccggcuggcucuggaaguuccucucccgcaagaagaagccccgcaucugcacccgcgaggaguucacccgcaagguccgcuccaacgccgccaucggcgccgucuucgucgacgagaaccaguggaacuccgccaaggaggccgucgacgacgagcgcuucugggaccucgucaaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgacaacucccucuccggcgucgagggcgagggccuccacaagcucggcuacauccuccgcgacaucgcccgcauccccggcggcaacauguacgccgacgacaccgccggcugggacacccgcaucaccgaggaggaccuccagaacgaggcccgcgucaccgagcucauggagcccgaccacgcccagcucgccaccuccaucuuccgccucaccuaccagaacaaggucguccgcguccagcgccccggcaagaacggcaccgucauggacgucaucucccgccgcgaccagcgcggcuccggccaggucggcaccuacggccucaacaccuucaccaacauggaggcccagcucauccgccagauggaguccgagggcgucuucucccccuccgagcucgagacccccaaccucgccaaccgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccucccgcggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucaccuccugggaggacguccccuaccucggcaagcgcgaggaccaguggugcggcucccucaucggccucuccgcccgcgccaccugggccaucaacauccaggucgccaucaaccagguccgcaagcucaucggcaacgagcacuaccaggacuacaugaccuccaugcgccgcuucaagaacgaguccgagcccgagggcgcccucugguga

SEQ ID NO: 11619 - RNA, 9879 nt, Artificial Sequence
  derived and/or modified CDS sequence (opt2) from DENV-1__DQ285561__SS-prME
uccgucaccaugcuccucaugcuccuccccaccgcccucaccuuccaccucaccacccgcggcggcgagccccacaugaucgucggcaagcaggagcgcggcaagucccuccucuucaagaccuccgccggcgucaacaugugcacccucaucgccauggaccucggcgagcucugcgacgacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaucuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaucuccuacgucaugugcaccggcuccuucaagcucgagaaggaggucgccgagacccagcacggcaccguccucguccaggucaaguacgagggcaccgacgcccccugcaagauccccuucuccucccaggacgagaagggcgucacccagaacggccgccucgucaccgccaaccccaucgucaccgacaaggagaagcccgucaacaucgaggccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcaugaucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucuccggcauccucgcccagggcaagaaguccauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaccaugggccagcucaccuggaacgaccucauccgccucugcaucauggucggcgccaacgccuccgacaacaugggcaugggcaccaccuaccucgcccucauggccaccuuccgcaugcgccccauguucgccgucggccuccucuuccgccgccucaccucccgcgagguccuccuccucaccgucggccucucccucgucgccuccgucgagcuccccaacucccucgaggagcucggcgacggccucgccaugggcaucaugauccucaagcuccucaccgacuuccagucccaccagcucugggccacccuccucucccucaccuucgucaagaccaccuucucccuccacuacgccuggaagaccauggccaugauccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagauccaggacgacggcaccaugaagaucaaggacgaggagcgcgacgacaccaucaccauccuccucaaggccacccuccucgccaucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagaaggacauccccgagcgcuccuggaacuccggcuacgacuggaucaccggcuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauguccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucgucgaggucgaccgcuccgaggccaaggagggccucaagcgcggcgagaccaucaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccgccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacaugggcgcccagcucauccgccagauggaguccgagggcaucuucucccccuccgagcucgagacccccaaccucgccggccgcguccucgacuggcucgagaagcacggcaucgagcgccuccgccgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11620 - RNA, 9879 nt, Artificial Sequence
  derived and/or modified CDS sequence (opt2) from DENV-1__DQ285562__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacaccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgucgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucguccgcuccauggucuccgccggcuccggcgaggucgacuccuucucccucggccuccucugcgucuccaucauggucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccaucgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucaccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacgucuacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacaucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaagcagguccgccgccucaucggcaacgagaacuaccucgacuacaugaccuccaugaagcgcuucaagaacgaguccgaccccgagggcgcccucugguga

SEQ ID NO: 11621 - RNA, 9879 nt, Artificial Sequence
  derived and/or modified CDS sequence (opt2) from DENV-1__DQ285558__SS-prME
uccgucaccaugcuccucaugcuccuccccaccgcccucaccuuccaccucaccacccgcggcggcgagccccacaugaucgucggcaagcaggagcgcggcaagucccuccucuucaagaccuccgccggcgucaacaugugcacccucaucgccauggaccucggcgagcucugcgacgacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaucuccuacgucaugugcaccggcuccuucaagcucgagaaggaggucgccgagacccagcacggcaccguccucguccaggucaaguacgagggcaccgacgcccccugcaagauccccuucuccucccaggacgagaagggcgucacccagaacggccgccucgucaccgccaaccccaucgucaccgacaaggagaagcccgucaacaucgaggccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggccucaucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucuccggcauccucgcccagggcaagaaguccauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaccaugggccagcucaccuggaacgaccucauccgccucugcaucauggucggcgccaacgccuccgacaacaugggcaugggcaccaccuaccucgcccucauggccaccuuccgcaugcgccccauguucgccgucggccuccucuuccgccgccucaccucccgcgagguccuccuccucaccgucggccucucccucgucgccuccgucgagcuccccaacucccucgaggagcucggcgacggccucgccaugggcaucaugauccucaagcuccucaccgacuuccagucccaccagcucugggccacccuccucucccucaccuucgucaagaccaccuucucccuccacuacgccuggaagaccauggccaugauccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagauccaggacgacggcaccaugaagaucaaggacgaggagcgcgacgacaccaucaccauccuccucaaggccacccuccucgccaucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagaaggacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauguccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucgucgaggucgaccgcuccgaggccaaggagggccucaagcgcggcgagaccaucaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccgccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacaugggcgcccagcucauccgccagauggaguccgagggcaucuucucccccuccgagcucgagacccccaaccucgccggccgcguccucgacuggcucgagaagcacggcaucgagcgccuccgccgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11622 - RNA, 9879 nt, Artificial Sequence
  derived and/or modified CDS sequence (opt2) from DENV-1__DQ285559__SS-prME
uccgucaccaugcuccucaugcuccuccccaccgcccucaccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaucgacuacggcgcccucacccucgacugcuccccccgcaccggccucgacuucaacgagaugguccuccucaccaugaagggcaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucacccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagaagcucuccgccgccaucggcaaggccugggaggagggcgucugcggcauccgcuccgccacccgccucgagaacaucauguggaagcagaucuccaacgagcucaacuacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccauccucaucgaggaggucaugcgcuccaaguggucccgcaagaugcucaugaccggcacccucgccgucuuccuccuccucaucaugggccagcucaccuggaacgaccucacccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagccccaccagcucuggaccacccuccucucccucaccuucaucaagaccacccucucccucgacuacgccuggaagaccauggccaugacccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagaaggacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcucaagggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccgccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccaagcgcguccucgacuggcucgagaaguacggcgccgagcgccucaagcgcauggccaucuccggcgacgacugcgucgucaagcccaucgacgaccgcuucgccaaggcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacauggccuccaugaagcgcuucaagaacgaguccgaccccgagggcgcccucugguga

SEQ ID NO: 11623 - RNA, 9879 nt, Artificial Sequence
  derived and/or modified CDS sequence (opt2) from DENV-1__AF311956__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggccgcgccugggaggagggcgucugcggcauccgcuccgccacccgccucgagaacaucauguggaagcagaucuccaacgagcucaaccacauccuccucgagaacgacaucaaguucaccgucgucgucggcaacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgagcagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauguacggcggccccaucucccagcacaacuaccgccccggcuacuucacccagaccgccggccccuggcaccucggcaagcucgagcucgacuucgaccucugcgagggcaccaccgucgucgucgacgagcacugcggcucccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacaagaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacgagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccauccucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggaccucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuucuuccccuccgagcucgagucccccaaccucgccgagcgcguccucgacuggcucgagaagcacggcgccgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11624 - RNA, 9879 nt, Artificial Sequence
  derived and/or modified CDS sequence (opt2) from DENV-1__AF311958__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcacccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggccgcgccugggaggagggcgucugcggcauccgcuccgccacccgccucgagaacaucauguggaagcagaucuccaacgagcucaaccacauccuccucgagaacgacaucaaguucaccgucgucgucggcaacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgagcagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauguacggcggccccaucucccagcacaacuaccgccccggcuacuucacccagaccgccggccccuggcaccucggcaagcucgagcucgacuucgaccucugcgagggcaccaccgucgucgucgacgagcacugcggcucccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacaagaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgaguacgagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggaggagccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggaccucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcgccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuucuuccccuccgagcucgagucccccaaccucgccgagcgcguccucgacuggcucgagaagcacggcgccgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11625 - RNA, 9879 nt, Artificial Sequence
  derived and/or modified CDS sequence (opt2) from DENV-1__AF311957__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggccgcgccugggaggagggcgucugcggcauccgcuccgccacccgccucgagaacaucauguggaagcagaucuccaacgagcucaaccacauccuccucgagaacgacaucaaguucaccgucgucgucggcaacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgagcagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauguacggcggccccaucucccagcacaacuaccgccccggcuacuucacccagaccgccggccccuggcaccucggcaagcucgagcucgacuucgaccucugcgagggcaccaccgucgucgucgacgagcacugcggcucccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacaagaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccaccguccucuccaucgucucccucuucccccucugccucuccaccaccucccagaagaccaccuggcuccccguccuccucggcuccuucggcugcaagccccucaccauguuccucaucaccgagaacgagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccuccgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggaccucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuucuuccccuccgagcucgagucccccaaccucgccgagcgcguccucgacuggcucgagaagcacggcgccgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11626 - RNA, 9879 nt, Artificial Sequence
  derived and/or modified CDS sequence (opt2) from DENV-1__EU280167__SS-prME
uccgucaccaugcuccucacccucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccgucaccuacaagugcccccgcaucaccgaggccgagcccgacgacgucgacugcuggugcaacgccaccgacaccugggucaccuacggcaccugcucccagaccggcgagcaccgccgcgacauccgcuccgucgcccucgccccccacgucggccucggccucgagacccgcaccgagaccuggauguccuccgagggcgccuggaagcagauccagcgcgucgacaccugcguccuccgccaccccggcuucaccgucaucgcccucuuccucgcccacgccaucggcaccuccaucucccagaagggcaucaucuucauccuccucaugcucgucacccccuccaugaccaugcgcugcgucggcaucggcucccgcgacuucgucgagggccucuccggcgccaccugggucgacgucguccucgagcacggcuccugcgucaccuccauggccaaggacaagcccacccucgacaucgagcuccucaagaccgagguccccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgacaaguucaagugcgucaccaagcucgagggcaagaucauccaguacgagaacuucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccgcgagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgucggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcggccucaagugcggcuccggcaucuucgucaccaacgagguccacaccuggaccggccaguacaaguuccaggccgacucccccaagggccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaagaacuggggcaaggccaagaucaucggcgccgacguccagaacuccaccuucaucaucgacggccccaacacccccgagugcuccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccucggcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccgcucccaccagcucugggccacccuccucuccaugaccuucaucaagaccgccuucucccuccacuacgccuggaagaccauggccaugguccucuccaucgucucccucuucccccucugccucuacaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucuggugcuucuggcagaagaagaagcagcgcuccggcguccucugggacacccccuccccccccaaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagaugcgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucaccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucauggacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaccaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucucccacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggucgucaccgcccgcuggcucugguccuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaccaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgagggcgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccaacgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcaucuccuccugggaggacguccccuaccucggcgagcgcgaggaccaguggugcggcucccucaucggccucaccgcccgcgccaccugggccaccaacguccaggucgccaucaaccagguccgccgccucaucggcaacgagaacuacuccgacuacaugaccuccaugaagcgcuucaagaacaaguccgagcccgagggcgcccucugguga

SEQ ID NO: 11627 - RNA, 9876 nt, Artificial Sequence
  derived and/or modified CDS sequence (opt2) from DENV-2__AJ968413__SS-prME
accgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucacccucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcucgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacgucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaccaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcacgccggcaagcgcucccuccgcccccagcccaccgagcuccgcuacuccuggaagaccuggggcaaggccaagauccucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccacccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcgucguccuccucucccaguccaccauccccgagaccauccucgagcucaccgacgcccucgcccucggcaugaugguccucaagaucguccgcaagauggagcgcuaccagcucgccgucaccaucaccgccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagaaggccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcaacggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcauccgcaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacauccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucuggggccucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11628 - RNA, 9876 nt, Artificial Sequence
  derived and/or modified CDS sequence (opt2) from DENV-2__AB543624__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaucggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccccgagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacaaccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucgcccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaacggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcaccccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccccccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaaccacacccacuucugcaucaagguccucaaccccuacaugcccuccguccucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcgccucaccgucaccgaggaggucgccguccacaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11629 - RNA, 9876 nt, Artificial Sequence
  derived and/or modified CDS sequence (opt2) from DENV-2__AB189122__SS-prME
accgccggcgucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgccccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgucggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaagaacaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccaggucuacaagaaguccggcauccaggaggucgaccgcacccucgccaaggagggcaucgagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11630 - RNA, 9876 nt, Artificial Sequence
  derived and/or modified CDS sequence (opt2) from DENV-2__AB189123__SS-prME
accgccggcgucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgccccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaagaacaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccaucgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucgagcgcggcgagaccgaccaccacgccgucucccgcggcuccgccaagcuccgcugcuucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaagaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccguccucgacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11631 - RNA, 9876 nt, Artificial Sequence
  derived and/or modified CDS sequence (opt2) from DENV-2__AB189124__SS-prME
accgccggcgucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgccccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaagaacaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucgagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaagaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11632 - RNA, 9876 nt, Artificial Sequence
  derived and/or modified CDS sequence (opt2) from DENV-2__AB122020__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11633 - RNA, 9876 nt, Artificial Sequence
  derived and/or modified CDS sequence (opt2) from DENV-2__LC121816__SS-prME
accgucggcaugaucaucaugcucauccccaccgccauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccgucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgcccacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggaggucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagcgcgacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggccuacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagcaccacaaccagacccuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgcccuccuccucgucgccgucuccuucaugacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugauccucaagaucguccgcaacauggagaaguaccagcucgccgucaccaucauggccauccucugcguccccaacgccgucauccuccagaacgccuggaaggucuccugcaccauccucgccgucgucuccgucaccccccuccuccucaccuccucccgccagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagaccaagcccggccucuucaagaccgacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaccggcgagacccucggcgagaaguggaagaaccgccucaacgcccucggcaaguccgaguuccagaccuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagauccgccaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccaaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacaugggcgcccagcucauccgccagauggagggcgagggcgucuucaaguccauccagcaccucaccgccaccgaggagaucgccguccaggacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11634 - RNA, 9876 nt, Artificial Sequence
  derived and/or modified CDS sequence (opt2) from DENV-2__LC111438__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgaguccccccccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcucccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagauccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucgcccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugaccaugggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucauggccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccaaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagaucgucaccaacuacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucgagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11635 - RNA, 9876 nt, Artificial Sequence
  derived and/or modified CDS sequence (opt2) from DENV-2__KF744400__SS-prME
accgccggcaugaucaucaugcucauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucacccucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaaggagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgacauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacgucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaccaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcacgccggcaagcgcucccuccgcccccagcccaccgagcuccgcuacuccuggaagaccuggggcaaggccaagauccucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgccuucugcgaccccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagcucgacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuacaagggcgaggacggcugcugguacggcauggagauccgcccccucaaggagaaggaggagaaccucgucuccucccucgucaccgccggccacggccagaucgacaacuucucccucggcguccucggcauggcccucuuccucgaggagaugcuccgcacccgcgucggcaugaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaagauggagcgcuaccagcucgccgucaccaucauggccauccucugcguccccaacuccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagaaggccgccgacguccgcugggaggaccaggccgagaucuccggcuccucccccauccucuccgucaucgucuccgaggacggcuccauguccaucaagaacgaggaggaggagcagauccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgacaagaagggcaaggucgucggccucuacggcaacggcgucgucacccgcaacggcuccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcauccgcaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgccaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcaccugcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgaggccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccucuacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucacccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11636 - RNA, 9876 nt, Artificial Sequence
  derived and/or modified CDS sequence (opt2) from DENV-2__KF744401__SS-prME
accgccggcaugaucaucaugcucauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucacccucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaaggagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacgucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaccaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcacgccggcaagcgcucccuccgcccccagcccaccgagcuccgcuacuccuggaagaccuggggcaaggccaagauccucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgccuucugcgaccccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagcucgacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuacaagggcgaggacggcugcugguacggcauggagauccgcccccucaaggagaaggaggagaaccucgucuccucccucgucaccgccggccacggccagaucgacaacuucucccucggcguccucggcauggcccucuuccucgaggagaugcuccgcacccgcgucggcaugaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaagauggagcgcuaccagcucgccgucaccaucauggccauccucugcguccccaacuccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagaaggccgccgacguccgcugggaggaccaggccgagaucuccggcuccucccccauccucuccgucaucgucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgacaagaagggcaaggucgucggccucuacggcaacggcgucgucacccgcaacggcuccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcauccgcaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgccaucgaccucgaccccauccccuacgaccccaaguucgagaagcagcucggccaggucaugcuccucguccucugcgucacccagguccucgucaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgaggccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccucuacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucacccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11637 - RNA, 9876 nt, Artificial Sequence
  derived and/or modified CDS sequence (opt2) from DENV-2__KF744402__SS-prME
accgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucacccucauggccgccauccucgccuacaccaucggcaccaccaacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacgucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucauccucgucggcgucgucacccucuaccucggcgucgucguccaggccgacuccggcugcgucgucuccuggcgcaacaaggagcucaagugcggcuccggcaucuucaucaccgacaacguccacaccuggaccgagcaguacaaguuccagcccgagucccccuccaagcucgccuccgccauccagaaggcccaccaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcacgccggcaagcgcucccuccgcccccagcccaccgagcuccgcuacuccuggaagaccuggggccgcgccaagauccucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacaccauccuccucgucgccgucuccuucgucacccucaucaccggcaacauguccuuccgcgaccucggccgcgucauggucauggucggcgccaccaugaccgacaacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaucaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaucaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgacaagaagggcaaggucgucggccucuacggcaacggcgucgucacccgcaacggcuccuacgucuccgccaucgcccagaccggcaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggaccacgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcauccgcaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgccaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11638 - RNA, 9876 nt, Artificial Sequence
  derived and/or modified CDS sequence (opt2) from DENV-2__KF744408__SS-prME
accgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucacccucauggccgccauccucgccuacaccaucggcaccaccaacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucggcuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacgucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucgucguccaggccgacuccggcugcgucgucuccuggcgcaacaaggagcucaagugcggcuccggcaucuucaucaccgacaacguccacaccuggaccgagcaguacaaguuccagcccgagucccccuccaagcucgccuccgccauccagaaggcccaccaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcuccgcuacuccuggaagaccuggggcaaggccaagauccucuccaccgagucccacaaccagaccuuccucaucgacggccccgagaccgccgagugccccaacaccaaccgcgccuggaacucccucgaggucgaggacuacggcuucggcgucuucaccaccaacaucuggcuccgccuccgcgagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcaagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagaaggccgccgacguccgcugggaggaccaggccgagaucuccggcuccucccccauccucuccaucaucaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgacaagaagggcaaggucgucggccucuacggcaacggcgucgucacccgcaacggcuccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcauccgcaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacaugaucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgccaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11639 - RNA, 9876 nt, Artificial Sequence
  derived and/or modified CDS sequence (opt2) from DENV-2__JX669476__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccaguccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgaguuccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaaggucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaagaccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggccgcgccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacgaccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11640 - RNA, 9876 nt, Artificial Sequence
  derived and/or modified CDS sequence (opt2) from DENV-2__JX475906__SS-prME
accgucggcaugaucaucaugcucauccccaccgccauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccgucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggaggucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagccccacaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgcccuccuccucgucgccgucuccuucaugacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugauccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccgccagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccaggccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacaugggcgcccagcucauccgccagauggagggcgagggcgucuucaaguccauccagcaccucaccgccaccgaggagaucgccguccaggacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11641 - RNA, 9876 nt, Artificial Sequence
  derived and/or modified CDS sequence (opt2) from DENV-2__JX669477__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacaccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggcccacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuuccgcuccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11642 - RNA, 9876 nt, Artificial Sequence
  derived and/or modified CDS sequence (opt2) from DENV-2__JX669478__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcaucuucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaucgacuacaugcccuccaugaagcgcuuccgccgcgaggaggaggaggccggcguccucugguga

SEQ ID NO: 11643 - RNA, 9876 nt, Artificial Sequence
  derived and/or modified CDS sequence (opt2) from DENV-2__JX669480__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucgccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcgaggagaucaagaucaccccccaguccuccaucaccgaggccgagcucaccggcuacggcaccgucaccauggagugcuccccccgcaccggccucgacuucaacgagaugguccuccuccagauggaggagaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgucaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccucaacgccuggaaggucuccugcaccauccucgccgccgucuccgucuccccccuccuccucaccuccucccagcagaagaccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacaccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11644 - RNA, 9876 nt, Artificial Sequence
  derived and/or modified CDS sequence (opt2) from DENV-2__JX669483__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucgccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcgaggagaucaagaucaccccccaguccuccaucaccgaggccgagcucaccggcuacggcaccgucaccauggagugcuccccccgcaccggccucgacuucaacgagaugguccuccuccagauggaggagaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucaucaagguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgucaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccucaacgccuggaaggucuccugcaccauccucgccgccgucuccgucuccccccuccuccucaccuccucccagcagaagaccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacaccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11645 - RNA, 9876 nt, Artificial Sequence
  derived and/or modified CDS sequence (opt2) from DENV-2__JX669484__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucgccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggagaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacggcaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucauggucauggucggcgucgccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucaugaccaucuccugcguccccaacgccgucauccuccucaacgccuggaaggucuccugcaccauccucgccgccgucuccgucuccccccuccuccucaccuccucccagcagaagaccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaucaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11646 - RNA, 9876 nt, Artificial Sequence
  derived and/or modified CDS sequence (opt2) from DENV-2__JX669485__SS-prME
accgccggcgucaucaucaugcucauccccaccgccauggccuuccaccucaccacccgcaacggcgagccccacaugaucgucggcaagcaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucgccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggagaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacggcaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucaucgucauggucggcgucaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccucaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcucgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11647 - RNA, 9876 nt, Artificial Sequence
  derived and/or modified CDS sequence (opt2) from DENV-2__JX669486__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucgccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcgaggagaucaagaucaccccccaguccuccaucaccgaggccgagcucaccggcuacggcaccgucaccauggagugcuccccccgcaccggccucgacuucaacgagaugguccuccuccagauggaggagaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgucaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccacccccgagaccauccucgagcucaccgacgcccucgcccucggcaugaugguccucaagaucguccgcaacauggagaaguaccagcucgccgucaccaucaugaccauccucugcguccccaacgccgucauccuccucaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucgucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccgucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11648 - RNA, 9876 nt, Artificial Sequence
  derived and/or modified CDS sequence (opt2) from DENV-2__JX669487__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucgccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucaugaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggagaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgucaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccuccgcaucguccgcaacauggagaaguaccagcucgccgucaccaucauggccaucuccugcguccccaacgccgucauccuccucaacgccuggaaggucuccugcaccauccucgccgccgucuccgucuccccccuccuccucaccuccucccagcagaagaccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccaucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaagcacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgccgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11649 - RNA, 9876 nt, Artificial Sequence
  derived and/or modified CDS sequence (opt2) from DENV-2__JX669488__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucgccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggagaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgccuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccuccgcaucguccgcaacauggagaaguaccagcucgccgucaccaucauggccaucuccugcguccccaacgccgucauccuccucaacgccuggaaggucuccugcaccauccucgccgccgucuccgucuccccccuccuccucaccuccucccagcagaagaccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccaucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaagcacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgccgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11650 - RNA, 9876 nt, Artificial Sequence
  derived and/or modified CDS sequence (opt2) from DENV-2__JX669479__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccaguccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggccgcgccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaaggcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11651 - RNA, 9876 nt, Artificial Sequence
  derived and/or modified CDS sequence (opt2) from DENV-2__KF744403__SS-prME
accgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucacccucauggccgccauccucgccuacaccaucggcaccaccaacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacgucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucgucguccaggccgacuccggcugcgucgucuccuggcgcaacaaggagcucaagugcggcuccggcaucuucaucaccgacaacguccacaccuggaccgagcaguacaaguuccagcccgagucccccuccaagcucgccuccgccauccagaaggcccaccaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcacgccggcaagcgcucccuccgcccccagcccaccgagcuccgcuacuccuggaagaccuggggcaaggccaagauccucuccaccgagucccacaaccagaccuuccucaucgacggccccgagaccgccgagugccccaacaccaaccgcgccuggaacucccucgaggucgaggacuacggcuucggcgucuucaccaccaacaucuggcuccgccuccgcgagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcaagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucuccucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaagauggagcgcuaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagaaggccgccgacguccgcugggaggaccaggccgagaucuccggcuccucccccauccucuccaucaucaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgacaagaagggcaaggucgucggccucuacggcaacggcgucgucacccgcaacggcuccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcauccgcaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagauccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacaugaucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgccaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11652 - RNA, 9876 nt, Artificial Sequence
  derived and/or modified CDS sequence (opt2) from DENV-2__KF744406__SS-prME
accgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucacccucauggccgccauccucgccuacaccaucggcaccaccaacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacgucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucgucguccaggccgacuccggcugcgucgucuccuggcgcaacaaggagcucaagugcggcuccggcaucuucaucaccgacaacguccacaccuggaccgagcaguacaaguuccagcccgagucccccuccaagcucgccuccgccauccagaaggcccaccaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcacgccggcaagcgcucccuccgcccccagcccaccgagcuccgcuacuccuggaagaccuggggcaaggccaagauccucuccaccgagucccacaaccagaccuuccucaucgacggccccgagaccgccgagugccccaacaccaaccgcgccuggaacucccucgaggucgaggacuacggcuucggcgucuucaccaccaacaucuggcuccgccuccgcgagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcaagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucuccucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaagauggagcgcuaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagaaggccgccgacguccgcugggaggaccaggccgagaucuccggcuccucccccauccucuccaucaucaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgacaagaagggcaaggucgucggccucuacggcaacggcgucgucacccgcaacggcuccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcauccgcaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagaucucccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacaugaucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgccaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11653 - RNA, 9876 nt, Artificial Sequence
  derived and/or modified CDS sequence (opt2) from DENV-2__KF744404__SS-prME
accgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucacccucauggccgccauccucgccuacaccaucggcaccaccaacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacgucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucgucguccaggccgacuccggcugcgucgucuccuggcgcaacaaggagcucaagugcggcuccggcaucuucaucaccgacaacguccacaccuggaccgagcaguacaaguuccagcccgagucccccuccaagcucgccuccgccauccagaaggcccaccaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcacgccggcaagcgcucccuccgcccccagcccaccgagcuccgcuacuccuggaagaccuggggcaaggccaagauccucuccaccgagucccacaaccagaccuuccucaucgacggccccgagaccgccgagugccccaacaccaaccgcgccuggaacucccucgaggucgaggacuacggcuucggcgucuucaccaccaacaucuggcuccgccuccgcgagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcaagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucuccucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaagauggagcgcuaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagaaggccgccgacguccgcugggaggaccaggccgagaucuccggcuccucccccauccucuccaucaucaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgacaagaagggcaaggucgucggccucuacggcaacggcgucgucacccgcaacggcuccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcauccgcaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccuccagaucucccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacaugaucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgccaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11654 - RNA, 9876 nt, Artificial Sequence
  derived and/or modified CDS sequence (opt2) from DENV-2__KF744407__SS-prME
accgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucacccucauggccgccauccucgccuacaccaucggcaccaccaacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacgucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgccuccuggaagaacaaggagcucaagugcggcuccggcaucuucaucaccgacaacguccacaccuggaccgagcaguacaaguuccagcccgagucccccuccaagcucgccuccgccauccagaaggcccaccaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcacgccggcaagcgcucccuccgcccccagcccaccgagcuccgcuacuccuggaagaccuggggcaaggccaagauccucuccaccgagucccacaaccagaccuuccucaucgacggccccgagaccgccgagugccccaacaccaaccgcgccuggaacucccucgaggucgaggacuacggcuucggcgucuucaccaccaacaucuggcuccgccuccgcgagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucuccucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagaaggccgccgacguccgcugggaggagcaggccgagaucuccggcuccucccccauccucuccaucaucaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgacaagaagggcaaggucgucggccucuacggcaacggcgucgucacccgcaacggcuccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcauccgcaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacaugaucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgccaccgaggagaucgccguccagaacuggcucacccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11655 - RNA, 9876 nt, Artificial Sequence
  derived and/or modified CDS sequence (opt2) from DENV-2__KF744399__SS-prME
accgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucacccucauggccgccauccucgccuacaccaucggcaccaccaacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucggcuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacgucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaccaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcacgccggcaagcgcucccuccgcccccagcccaccgagcuccgcuacuccuggaaggccuggggcaaggccaagauccucuccaccgagcuccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcaagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaagauggagcgcuaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagaaggccgccgacguccgcugggaggagcaggccgagaucuccggcuccucccccauccucuccaucaucaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgccucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcaacggcuccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcauccgcaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgccaccgaggagaacgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagaacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11656 - RNA, 9876 nt, Artificial Sequence
  derived and/or modified CDS sequence (opt2) from DENV-2__JX286516__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaucgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaagggcuucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11657 - RNA, 9876 nt, Artificial Sequence
  derived and/or modified CDS sequence (opt2) from DENV-2__JX286518__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11658 - RNA, 9876 nt, Artificial Sequence
  derived and/or modified CDS sequence (opt2) from DENV-2__JX286519__SS-prME
accgccggcgucaucgucaugcucauccccaccgccauggccuuccaccucaccacccgcaacggcgagccccacaugaucgucggccgccaggagaagggcaagucccuccucuucaagaccgaggacggcaucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucguccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcuccgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11659 - RNA, 9876 nt, Artificial Sequence
  derived and/or modified CDS sequence (opt2) from DENV-2__KP188549__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagauggucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcgagaagcgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaccgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11660 - RNA, 9876 nt, Artificial Sequence
  derived and/or modified CDS sequence (opt2) from DENV-2__KP188550__SS-prME
accgccggcgucaucgucaugcucauccccaccgucauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggccgcgcccacacccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcaccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccaaguggcucuggaaggagcucggcaaggagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaagaacauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11661 - RNA, 9876 nt, Artificial Sequence
  derived and/or modified CDS sequence (opt2) from DENV-2__KP188553__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagauggucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcgagaagcgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccccuacucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaccgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11662 - RNA, 9876 nt, Artificial Sequence
  derived and/or modified CDS sequence (opt2) from DENV-2__KP188556__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagauggucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcgagaagcgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccaucccccacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaccgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11663 - RNA, 9876 nt, Artificial Sequence
  derived and/or modified CDS sequence (opt2) from DENV-2__GU369819__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccgcgccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacaucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccaggucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccccccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11664 - RNA, 9876 nt, Artificial Sequence
  derived and/or modified CDS sequence (opt2) from DENV-2__JX649147__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccaguccgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagaaggcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaaggagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaagaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccucaagaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccauguccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucaucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccaggacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11665 - RNA, 9876 nt, Artificial Sequence
  derived and/or modified CDS sequence (opt2) from DENV-2__KF704356__SS-prME
accgccggcaugaucaucaugcucauccccaccgucauggccuuccaccucaccacccgcaacggcgagccccacaugaucgucucccgccaggagaagggcaagucccuccucuucaacaccggcgacggcguccacaugugcacccucauggccaugcaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgaccucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcuccaucgucaccugcgccauguucaccugcaagaagaucaugaagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaacguccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccggcaaggacucccccgucaacaucgaggccgagccccccuucggcgacuccuacaucaucaucggcgucgagcccggccagcucaagcucaacugguucaagaagggcuccuccaucggccagauguucgccaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgaggagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaugguccgcaagauggagaaguaccagcucgccgucaccaucauggccauccucugcguccccaacgccgucauccuccagaacaccuggaaggucuccugcaccauccucgccgucgucuccgucuccccccucuuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagcgcaagcucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccugguccuccggccacgagugggucaccgacuucaagggcaagaccgucugguucguccccuccauccgcgccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccucuuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuucgagcccgacgucgaccucggcuccggcacccgcaacaucggcaucgaguccgagauccccaaccucgacaucaucggcaagcgcaucgagaagaucaagcaggaguacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11666 - RNA, 9876 nt, Artificial Sequence
  derived and/or modified CDS sequence (opt2) from DENV-2__KF704355__SS-prME
accgccggcaugaucaucaugcucauccccaccgucauggccuuccaccucaccacccgcaacggcgagccccacaugaucgucucccgccaggagaagggcaagucccuccucuucaagaccggcgacggcgucaacaugugcacccucauggccauggaccucggcgagcucugcgaggacaccaucaccuacaagugccccuuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgaccucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcuccaucgucaccugcgccauguucaccugcaagaagaucaugaagggcaaggucguccagcccgagaaccucgaguacaccaucgucaucaccccccacuccggcgaggagcacgccgucggcaacgacaccggcaaguacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaacguccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccggcaaggacucccccgucaacaucgaggccgagccccccuucggcgacuccuacaucaucaucggcgucgagcccggccagcucaagcucaacugguucaagaagggcuccuccaucggccagauguucggcaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaccggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaugguccgcaagauggagaaguaccagcucgccgucaccaucauggccauccucugcguccccaacgccgucauccuccagaacgccuggaaggucuccugcaccauccucgccgucgucuccgucuccccccucuuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagcgcaagcucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccugguccuccggccacgagugggucaccgacuucaagggcaagaccgucugguucguccccuccauccgcgccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccucuuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggaguacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11667 - RNA, 9876 nt, Artificial Sequence
  derived and/or modified CDS sequence (opt2) from DENV-2__KF704354__SS-prME
accgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugccccuuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaucaugaagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaacguccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccggcaaggacucccccgucaacaucgaggccgagccccccuucggcgacuccuacaucaucaucggcgucgagcccggccagcucaagcucaacugguucaagaagggcuccuccaucggccagauguucgccaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgaggagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaugguccgcaagauggagaaguaccagcucgccgucaccaucauggccauccucugcguccccaacgccgucauccuccagaacaccuggaaggucuccugcaccauccucgccgucgucuccgucuccccccucuuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggcgccucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgcaagcucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccugguccuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuggggcuccaucaccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccucuuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuucgagcccgacgucgaccucggcuccggcacccgcaacaucggcaucgaguccgagauccccaaccucgacaucaucggcaagcgcaucgagaagaucaagcaggaguacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11668 - RNA, 9876 nt, Artificial Sequence
  derived and/or modified CDS sequence (opt2) from DENV-2__KF704357__SS-prME
accgccggcaugaucaucaugcucauccccaccgucauggccuuccaccucaccacccgcaacggcgagccccacaugaucgucucccgccaggagaagggcaagucccuccucuucaagaccggcgacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgaccucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcuccaucgucaccugcgccauguucaccugcaagaagaucaugaagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaacguccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccggcaaggacucccccgucaacaucgaggccgagccccccuucggcgacuccuacaucaucaucggcgucgagcccggccagcucaagcucaacugguucaagaagggcuccuccaucggccagauguucgccaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgaggagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaugguccgcaagauggagaaguaccagcucgccgucaccaucauggccauccucugcguccccaacgccgucauccuccagaacaccuggaaggucuccugcaccauccucgccgucgucuccgucuccccccucuuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagcgcaagcucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccugguccuccggccacgagugggucaccgacuucaagggcaagaccgucugguucguccccuccauccgcgccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccucuuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuucgagcccgacgucgaccucggcuccggcacccgcaacaucggcaucgaguccgagauccccaaccucgacaucaucggcaagcgcaucgagaagaucaagcaggaguacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11669 - RNA, 9876 nt, Artificial Sequence
  derived and/or modified CDS sequence (opt2) from DENV-2__KF704358__SS-prME
accgccggcaugaucaucaugcucauccccaccgucauggccuuccaccucaccacccgcaacggcgagccccacaugaucgucucccgccaggagaagggcaagucccuccucuucaacaccggcgacggcguccacaugugcacccucauggccaugcaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgaccucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcuccaucgucaccugcgccauguucaccugcaagaagaucaugaagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaacguccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccggcaaggacucccccgucaacaucgaggccgagccccccuucggcgacuccuacaucaucaucggcgucgagcccggccagcucaagcucaacugguucaagaagggcuccuccaucggccagauguucgccaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaccggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaugguccgcaagauggagaaguaccagcucgccgucaccaucauggccauccucugcguccccaacgccgucauccuccagaacaccuggaaggucuccugcaccauccucgccgucgucuccgucuccccccucuuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgcaagcucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccugguccuccggccacgagugggucaccgacuucaagggcaagaccgucugguucguccccuccauccgcgccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccucuuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuucgagcccgacgucgaccucggcuccggcacccgcaacaucggcaucgaguccgagauccccaaccucgacaucaucggcaagcgcaucgagaagaucaagcaggaguacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11670 - RNA, 9876 nt, Artificial Sequence
  derived and/or modified CDS sequence (opt2) from DENV-2__KF041232__SS-prME
accgccggcgucaucaucaugcucauccccaccgccauggccuuccaccucaccacccgcaacggcgagccccacaugaucgucuccaagcaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacgccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacauccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucuccaucaugaccggcgacaucaagggcaucaugcaggccggcaagcgcucccuccgcccccagcccaccgagcucaaguacuccuggaagaccuggggcaaggccaagaugcucuccaccgagccccacaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccguccuccucgucgccgucuccuucaugacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccacccccgagaccauccucgagcucaccgacgcccucgcccucggcaugaugauccucaagaucguccgcaacauggagaaguaccagcucgccgucaccaucauggccauccucugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaccggcgagacccucggcgagaaguggaagaaccgccucaacucccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucgcccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagaucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacaugggcgcccagcucauccgccagauggagggcgagggcgucuucaagggcauccagcaccucaccgccaccgaggaggucgccguccaggacuggcucgcccgcgucggccgcgagcgccucucccgcauggccaucuccggcgacgacugcgucgucaagccccucgacgaccgcuucgccaacgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgcccgccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggcccgcaacauccagaccgccaucaaccagguccgcucccucaucggcuccgaggaguacaccgacuacaugcccuccaugaagcgcuuccgccgcgaggaggaggaggccggcguccucugguga

SEQ ID NO: 11671 - RNA, 9876 nt, Artificial Sequence
  derived and/or modified CDS sequence (opt2) from DENV-2__KF041233__SS-prME
accgccggcgucaucaucaugcucauccccaccgccauggccuuccaccucaccacccgcaacggcgagccccacaugaucgucuccaagcaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacauccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccgccgccauccagaaggcccacgaggagggcaucugcggcauccgcuccgucacccgccucgagaaccucauguggaagcagaucacccccgagcucaaccacauccucuccgagaacgaggucaagcucuccaucaugaccggcgacaucaagggcaucaugcaggccggcaagcgcucccuccgcccccagcccaccgagcucaaguacuccuggaagaccuggggcaaggccaagaugcucuccaccgagccccacaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccguccuccucaucgccgucuccuucaugacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccacccccgagaccauccucgagcucaccgacgcccucgcccucggcaugaugauccucaagaucguccgcaacauggagaaguaccagcucgccgucaccaucauggccauccucugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagaagcucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaccggcgagacccucggcgagaaguggaagaaccgccucaacucccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucgcccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagaucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacaugggcgcccagcucauccgccagauggagggcgagggcgucuucaagggcauccagcaccucaccgccaccgaggaggucgccguccaggacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgcccgccacgaguggaugaccaccgaggacaugcucaccgucuggaaccgcgucuggauccaggagaaccccuggauggaggacaagacccucgucgaguccugggaggagauccccuaccucggcaagcgcgaggaccaguggugcggcucccucaucggccucaccucccgcgccaccugggcccgcaacauccagaccgccaucaaccagguccgcucccucaucggcuccgaggaguacaccgacuacaugcccuccaugaagcgcuuccgccgcgaggaggaggaggccggcguccucugguga

SEQ ID NO: 11672 - RNA, 9876 nt, Artificial Sequence
  derived and/or modified CDS sequence (opt2) from DENV-2__KF041234__SS-prME
accgccggcgucaucaucaugcucauccccaccgccauggccuuccaccucaccacccgcaacggcgagccccacaugaucgucuccaagcaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacgccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacauccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucaucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucuccaucaugaccggcgacaucaagggcaucaugcaggccggcaagcgcucccuccgcccccagcccaccgagcucaaguacuccuggaagaccuggggcaaggccaagaugcucuccaccgagccccacaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccguccuccucgucgccgucuccuucaugacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccacccccgagaccauccucgagcucaccgacgcccucgcccucggcaugaugauccucaagaucguccgcaacauggagaaguaccagcucgccgucaccaucauggccauccucugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaccggcgagacccucggcgagaaguggaagaaccgccucaacucccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucgcccgcaagguccgcuccaacgccgcccucggcgccaucuucaccgacgagaacaaguggaaguccgcccgcgaggccgucgaggacucccgcuucugggagcucgucgacaaggagcgcgaccuccaccucgagggcaagugcgagaccugcgucuacaacaugaugggcaagcgcgagaagaagaucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacaugggcgcccagcucauccgccagauggagggcgagggcgucuucaagggcauccagcaccucaccgccaccgaggaggucgccguccaggacuggcucgcccgcgucggccgcgagcgccucucccgcauggccaucuccggcgacgacugcgucgucaagccccucgacgaccgcuucgccaacgcccucaccgcccucaacgacaugggcaagguccgcaaggacauccagcagugggagcccucccgcggcugguccgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgcccgccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggcccgcaacauccagaccgccaucaaccagguccgcucccucaucggcuccgaggaguacaccgacuacaugcccuccaugaagcgcuuccgccgcgaggaggaggaggccggcguccucugguga

SEQ ID NO: 11673 - RNA, 9876 nt, Artificial Sequence
  derived and/or modified CDS sequence (opt2) from DENV-2__KF041235__SS-prME
accgccggcgucaucaucaugcucauccccaccgccauggccuuccaccucaccacccgcaacggcgagccccacaugaucgucuccaagcaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacauccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucuccaucaugaccggcgacaucaagggcaucaugcaggccggcaagcgcucccuccgcccccagcccaccgagcucaaguacuccuggaagaccuggggcaaggccaagaugcucuccaccgagccccacaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccguccuccucgucgccgucuccuucaugacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccacccccgagaccauccucgagcucaccgacgcccucgcccucggcaugaugauccucaagaucguccgcaacauggagaaguaccagcucgccgucaccaucauggccauccucugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaccggcgagacccucggcgagaaguggaagaaccgccucaacucccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucgcccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagaucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacaugggcgcccagcucauccgccagauggagggcgagggcgucuucaagggcauccagcaccucaccgccaccgaggaggucgccguccaggacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgcccgccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggcccgcaacauccagaccgccaucaaccagguccgcucccucaucggcuccgaggaguacaccgacuacaugcccuccaugaagcgcuuccgccgcgaggaggaggaggccggcguccucugguga

SEQ ID NO: 11674 - RNA, 9876 nt, Artificial Sequence
  derived and/or modified CDS sequence (opt2) from DENV-2__KF041237__SS-prME
accgccggcgucaucaucaugcucauccccaccgccauggccuuccaccucaccacccgcaacggcgagccccacaugaucgucuccaagcaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacauccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucuccaucaugaccggcgacaucaagggcaucaugcaggccggcaagcgcucccuccgcccccagcccaccgagcucaaguacuccuggaagaccuggggcaaggccaagaugcucuccaccgagccccacaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccguccuccucgucgccgucuccuucaugacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccacccccgagaccauccucgagcucaccgacgcccucgcccucggcaugaugauccucaagaucguccgcaacauggagaaguaccagcucgccgucaccaucauggccauccucugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaccggcgagacccucggcgagaaguggaagaaccgccucaacucccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucgcccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagaucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacaugggcgcccagcucauccgccagauggagggcgagggcgucuucaagggcauccagcaccucaccgccaccgaggaggucgccguccaggacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccggccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggcccgcaacauccagaccgccaucaaccagguccgcucccucaucggcuccgaggaguacaccgacuacaugcccuccaugaagcgcuuccgccgcgaggaggaggaggccggcguccucugguga

SEQ ID NO: 11675 - RNA, 9876 nt, Artificial Sequence
  derived and/or modified CDS sequence (opt2) from DENV-2__KM217156__SS-prME
accgccggcgucaucaucaugcucauccccaccgccauggccuuccaccucaccacccgcaacggcgagccccacaugaucgucuccaagcaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacgccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacauccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaacccccucuucaccggccaccucaagugccgccuccgcauggacaagcuccagcucaagggcauguccuacuccaugugcaccggcaaguucaaggucgucaaggagaucgccgagacccagcacggcaccaucgucguccgcauccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucuucaccgacaacguccacaccuggaccgagcaguacaaguuccagcccgagucccccuccaagcucgccuccgccauccagaaggcccacgaggagggcaucugcggcauccgcuccaucacccgccucgacaaccucauguggaagcagaucacccccgagcucaaccacauccucuccgagaacgaggucaagcucuccaucaugaccggcgacaucaagggcaucaugcaggccggcaagcgcucccuccgcccccagcccaccgagcucaaguacuccuggaagaccuggggcaaggccaagaugcucuccaccgagccccacaaccagaccuuccucaucgacggccccgagaccgcccagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccguccuccucgucgccgucuccuucaugacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccacccccgagaccauccucgagcucaccgacgcccucgcccucggcaugaugauccucaagaucguccgcaacauggagaaguaccagcucgccgucaccaucauggccauccucugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccgcccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccucccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaccggcgagacccucggcgagaaguggaagaaccgcgucucccuccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccucaccggcgccgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgaccccgacgucgaccucggcuccggcacccgcaacaucggcaucgaguccgagacccccaaccucgacaucaucggcaagcgcaucgagaagaucaagcaggagcacgagaccucccgccacuacgaccaggaccaccccuacaagaccugggccuaccacggcuccuacgagaccaagcagaccggcuccgccuccuccaccgucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucgcccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagaucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccguccaggucggcaccuacggccucggcaccuucaccaacaugggcgcccagcucauccgccagauggagggcgagggcgucuucaagggcauccagcaccucaccgccaccgaggaggucgccguccaggacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucgucgccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccggccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggcccgcaacauccagaccgccaucaaccagguccgcucccucaucggcuccgaggaguacaccgacuacaugcccuccaugaagcgcuucggccgcgaggaggaggaggccggcguccucugguga

SEQ ID NO: 11676 - RNA, 9876 nt, Artificial Sequence
  derived and/or modified CDS sequence (opt2) from DENV-2__KX380809__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccgucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgccaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgacuccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagauccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcaccgcaagcucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucgagcgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11677 - RNA, 9876 nt, Artificial Sequence
  derived and/or modified CDS sequence (opt2) from DENV-2__KX380810__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccgucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgccaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccggcaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgacuccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagauccccgccgccgacaucggcaccgucaucgaccucgaccccauccccuacgaccccaaguucgagaagcagcucggccaggucaugcuccucguccucugcuccacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcaccgcaagcucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucgagcgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaucucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11678 - RNA, 9876 nt, Artificial Sequence
  derived and/or modified CDS sequence (opt2) from DENV-2__KX380811__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaaccucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagauccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11679 - RNA, 9876 nt, Artificial Sequence
  derived and/or modified CDS sequence (opt2) from DENV-2__KX380813__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggaguccgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcacccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagauccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagaaggagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccucccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11680 - RNA, 9876 nt, Artificial Sequence
  derived and/or modified CDS sequence (opt2) from DENV-2__KX380814__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcacccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagauccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagaaggagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccucccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11681 - RNA, 9876 nt, Artificial Sequence
  derived and/or modified CDS sequence (opt2) from DENV-2__KX380807__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgccccccacgucggcaugggccucgagacccgcaccgagaccuggauguccuccgagggcgccuggaagcacgcccagcgcaucgagaucuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacaacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccgucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcaccgccgccggcaucaugaagauccccgccgcccucaucgucaccgucaucgaccucgaccccauccccuacgaccccaaguucgagaagcagcucggccaggucaugcuccucguccucugcuccacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucacccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgccaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11682 - RNA, 9876 nt, Artificial Sequence
  derived and/or modified CDS sequence (opt2) from DENV-2__KX380815__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuccugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaagaccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccuccuuccucaagaacgacauccccaugaccggcccccucgucgccggcggccuccucaccgucugcuacguccucaccggccgcuccgccgaccucgagcucgagcgcgccgccgacauccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaagaacaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucgucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagauccccgccgcccucaucaugaccgucaucgaccucgaccccauccccuacgaccccaaguucgagaagcagcucggccaggucaugcuccucguccucugcuccacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccagcucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgccaccgaggagaucgccgucaagaacuggcucguccgcgucggccgcgagcgccucucccgcauggccaucuccggcgacgacugcgucgucaagccccucgacgaccgcuucgccaacgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11683 - RNA, 9876 nt, Artificial Sequence
  derived and/or modified CDS sequence (opt2) from DENV-2__KX380816__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcacccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagauccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagaaggagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucuggcacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccucccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11684 - RNA, 9876 nt, Artificial Sequence
  derived and/or modified CDS sequence (opt2) from DENV-2__KX380817__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11685 - RNA, 9876 nt, Artificial Sequence
  derived and/or modified CDS sequence (opt2) from DENV-2__KX380818__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuccugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaagaccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccuccuuccucaagaacgacauccccaugaccggcccccucgucgccggcggccuccucaccgucugcuacguccucaccggccgcuccgccgaccucgagcucgagcgcgccgccgacauccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaagaacaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucgucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagauccccgccgccgacaucggccgcgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccagcucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgccaccgaggagaucgccgucaagaacuggcucguccgcgucggccgcgagcgccucucccgcauggccaucuccggcgacgacugcgucgucaagccccucgacgaccgcuucgccaacgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11686 - RNA, 9876 nt, Artificial Sequence
  derived and/or modified CDS sequence (opt2) from DENV-2__KX380819__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccgucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcaucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgccaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgacuccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagauccccgccgcccucaucggccgcgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcaccgcaagcucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucgagcgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaucucccgcaccaccugguccauccacgccacccacgaguggaugaccaccgaggacaugcucaccgccuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11687 - RNA, 9876 nt, Artificial Sequence
  derived and/or modified CDS sequence (opt2) from DENV-2__KX380821__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccgucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgccaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcacccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagauccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagaaggagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11688 - RNA, 9876 nt, Artificial Sequence
  derived and/or modified CDS sequence (opt2) from DENV-2__KX380822__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccgucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgccaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucaugaccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucaccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgacuccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagauccccgccgccgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcaccgcaagcucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucgagcgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11689 - RNA, 9876 nt, Artificial Sequence
  derived and/or modified CDS sequence (opt2) from DENV-2__KX380828__SS-prME
accgccggcgucaucaucaugcucauccccaccgccauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagaugcucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagccccacaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuacaagggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccguccuccucgucgccgucuccuucaugacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugauccucaagaucguccgcaacauggagaaguaccagcucgccgucaccaucauggccauccucugcgcccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgagcucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagaagaagaagcucaagccccgcuggcucgacgcccgcaucuacuccgacccccucgcccucaaggaguucaaggaguucgccgccggccgcaagucccucaccaugaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgucgcccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagauccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaccggcgagacccucggcgagaaguggaagaaccgccucaacucccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucauggaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagaucggcgaguucggccgcgccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacaugggcgcccagcucauccgccagauggagggcgagggcgucuucaaguccauccagcaccucaccaccaccgaggaggucgccguccaggacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgcccgccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcuccgaggaguacaccgacuacaugcccuccaugaagcgcuuccgccgcgaggaggaggaggccggcguccucugguga

SEQ ID NO: 11690 - RNA, 9876 nt, Artificial Sequence
  derived and/or modified CDS sequence (opt2) from DENV-2__KX380829__SS-prME
accgccggcgucaucaucaugcucauccccaccgccauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagaugcucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagccccacaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuacaagggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccguccuccucgucgccgucuccuucaugacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugauccucaagaucguccgcaacauggagaaguaccagcucgccgucaccaucauggccauccucugcgcccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgagcucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagaagaagaagcucaagccccgcuggcucgacgcccgcaucuacuccgacccccucgcccucaaggaguucaaggaguucgccgccggccgcaagucccucaccaugaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgucgcccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaccggcgagacccucggcgagaaguggaagaaccgccucaacucccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucauggaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagaucggcgaguucggccgcgccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacaugggcgcccagcucauccgccagauggagggcgagggcgucuucaaguccauccagcaccucaccaccaccgaggaggucgccguccaggacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgcccgccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcuccgaggaguacaccgacuacaugcccuccaugaagcgcuuccgccgcgaggaggaggaggccggcguccucugguga

SEQ ID NO: 11691 - RNA, 9876 nt, Artificial Sequence
  derived and/or modified CDS sequence (opt2) from DENV-2__KX380830__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccgucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgccaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgacuccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagauccccgccgccgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcaccgcaagcucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucgagcgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaucucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11692 - RNA, 9876 nt, Artificial Sequence
  derived and/or modified CDS sequence (opt2) from DENV-2__KX380831__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaaccucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaccaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11693 - RNA, 9876 nt, Artificial Sequence
  derived and/or modified CDS sequence (opt2) from DENV-2__KX380808__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccucaagcagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccaucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgagaucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacaccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucacccacuacgccaucaucggccccggccuccaggccaaggccacccgcgaggcccagaagcgcgccgccgccggcaucaugaagauccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggccucuucaaguccauccagcaccucaccgucaccgaggagaucgccgucaagaacuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11694 - RNA, 9876 nt, Artificial Sequence
  derived and/or modified CDS sequence (opt2) from DENV-2__KX380832__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccgucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgccaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucaugaccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucaccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgacuccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagauccccgccgccgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcaccgcaagcucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucgagcgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11695 - RNA, 9876 nt, Artificial Sequence
  derived and/or modified CDS sequence (opt2) from DENV-2__KX380833__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccgucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgccaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgacuccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagauccccgccgccgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcaccgcaagcucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucgagcgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaucucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11696 - RNA, 9876 nt, Artificial Sequence
  derived and/or modified CDS sequence (opt2) from DENV-2__KX380834__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaaccucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11697 - RNA, 9876 nt, Artificial Sequence
  derived and/or modified CDS sequence (opt2) from DENV-2__KX380835__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccgucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgccaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgacuccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcaccgcaagcucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucgagcgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaucucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11698 - RNA, 9876 nt, Artificial Sequence
  derived and/or modified CDS sequence (opt2) from DENV-2__KX380836__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccgucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgccaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcaccgcaagcucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucgagcgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaucucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11699 - RNA, 9876 nt, Artificial Sequence
  derived and/or modified CDS sequence (opt2) from DENV-2__KX380838__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccgucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgccaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccacccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgacuccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagauccccgccgccgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcaccgcaagcucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgucaccgaggagaucgccgucaagaacuggcucgagcgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaucucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11700 - RNA, 9876 nt, Artificial Sequence
  derived and/or modified CDS sequence (opt2) from DENV-2__KM279515__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacgcccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgagaccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11701 - RNA, 9876 nt, Artificial Sequence
  derived and/or modified CDS sequence (opt2) from DENV-2__KM279516__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaacauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11702 - RNA, 9876 nt, Artificial Sequence
  derived and/or modified CDS sequence (opt2) from DENV-2__KM279517__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgaguccccccccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11703 - RNA, 9876 nt, Artificial Sequence
  derived and/or modified CDS sequence (opt2) from DENV-2__KM279518__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccagaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11704 - RNA, 9876 nt, Artificial Sequence
  derived and/or modified CDS sequence (opt2) from DENV-2__KM279519__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagaaggagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgccguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11705 - RNA, 9876 nt, Artificial Sequence
  derived and/or modified CDS sequence (opt2) from DENV-2__KM279520__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggcccgcaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacgcccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgagaccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11706 - RNA, 9876 nt, Artificial Sequence
  derived and/or modified CDS sequence (opt2) from DENV-2__KM279521__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacuccaccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11707 - RNA, 9876 nt, Artificial Sequence
  derived and/or modified CDS sequence (opt2) from DENV-2__KM279583__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagauggcccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11708 - RNA, 9876 nt, Artificial Sequence
  derived and/or modified CDS sequence (opt2) from DENV-2__KM279585__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgacaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggaaccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11709 - RNA, 9876 nt, Artificial Sequence
  derived and/or modified CDS sequence (opt2) from DENV-2__KM279525__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucauccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaacauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11710 - RNA, 9876 nt, Artificial Sequence
  derived and/or modified CDS sequence (opt2) from DENV-2__KM279528__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccaaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11711 - RNA, 9876 nt, Artificial Sequence
  derived and/or modified CDS sequence (opt2) from DENV-2__KM279533__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgagaacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11712 - RNA, 9876 nt, Artificial Sequence
  derived and/or modified CDS sequence (opt2) from DENV-2__KM279535__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11713 - RNA, 9876 nt, Artificial Sequence
  derived and/or modified CDS sequence (opt2) from DENV-2__KM279539__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgaggaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11714 - RNA, 9876 nt, Artificial Sequence
  derived and/or modified CDS sequence (opt2) from DENV-2__KM279543__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcauguucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11715 - RNA, 9876 nt, Artificial Sequence
  derived and/or modified CDS sequence (opt2) from DENV-2__KM279571__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcacccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagauccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagaaggagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11716 - RNA, 9876 nt, Artificial Sequence
  derived and/or modified CDS sequence (opt2) from DENV-2__KM279544__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaccuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcauguucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccucgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11717 - RNA, 9876 nt, Artificial Sequence
  derived and/or modified CDS sequence (opt2) from DENV-2__KM279549__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgucgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11718 - RNA, 9876 nt, Artificial Sequence
  derived and/or modified CDS sequence (opt2) from DENV-2__KM279552__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccacuccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11719 - RNA, 9876 nt, Artificial Sequence
  derived and/or modified CDS sequence (opt2) from DENV-2__KM279557__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacuccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11720 - RNA, 9876 nt, Artificial Sequence
  derived and/or modified CDS sequence (opt2) from DENV-2__KM279591__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcacccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgucgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11721 - RNA, 9876 nt, Artificial Sequence
  derived and/or modified CDS sequence (opt2) from DENV-2__KM279558__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11722 - RNA, 9876 nt, Artificial Sequence
  derived and/or modified CDS sequence (opt2) from DENV-2__KM279564__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaucgaggaggaggaggccggcguccucugguga

SEQ ID NO: 11723 - RNA, 9876 nt, Artificial Sequence
  derived and/or modified CDS sequence (opt2) from DENV-2__KM279595__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcacccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaagaacaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagaaggagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaaggacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11724 - RNA, 9876 nt, Artificial Sequence
  derived and/or modified CDS sequence (opt2) from DENV-2__KM279566__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcacccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagaaggagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11725 - RNA, 9876 nt, Artificial Sequence
  derived and/or modified CDS sequence (opt2) from DENV-2__KM279574__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcacccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagauccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagaaggagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccucccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucgagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucacccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11726 - RNA, 9876 nt, Artificial Sequence
  derived and/or modified CDS sequence (opt2) from DENV-2__KM279568__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacaucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11727 - RNA, 9876 nt, Artificial Sequence
  derived and/or modified CDS sequence (opt2) from DENV-2__KM279569__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcacccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagaaggagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaaggacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11728 - RNA, 9876 nt, Artificial Sequence
  derived and/or modified CDS sequence (opt2) from DENV-2__KM279570__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgccgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11729 - RNA, 9876 nt, Artificial Sequence
  derived and/or modified CDS sequence (opt2) from DENV-2__KM279596__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucacccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccucgccacccuccgcaaguacugcgucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucaccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgccgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgaguccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggccaagaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaugaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcagcucaccgucaaggaggagaucgccgucaagaacuggcucauccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggauccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11730 - RNA, 9876 nt, Artificial Sequence
  derived and/or modified CDS sequence (opt2) from DENV-2__FJ850072__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucgccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcgaggagaucaagaucaccccccaguccuccaucaccgaggccgagcucaccggcuacggcaccgucaccauggagugcuccccccgcaccggccucgacuucaacgagaugguccuccuccagauggaggagaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacgcccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgucgccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucaugaccaucuccugcguccccaacgccaugauccuccucaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccucucccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccgucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcaugcucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11731 - RNA, 9876 nt, Artificial Sequence
  derived and/or modified CDS sequence (opt2) from DENV-2__JN819419__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcgucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcgucgcccuccucucccaguccaccauccccgagaccauccucgagcucaccgacgcccucgcccucggcaugauggcccucaagaucgucaagaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucgucuccuacggcggcggcuggaagcucgagggcgaguggaaggagggcgaggagguccagguccucgcccucgagcccggcaagaacccccgcgccguccagaccaagcccggcaucuucaagaccaacaccggcaacaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgccccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaucccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucacccgcauggccaucuccggcgacgacugcgucgucaagcccaucgacgaccgcuucgccaacgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11732 - RNA, 9876 nt, Artificial Sequence
  derived and/or modified CDS sequence (opt2) from DENV-2__FJ850074__SS-prME
accgccggcgucaucgucaugcucauccccaccgucauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaugauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcgucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcuccccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcgucgcccuccucucccaguccaccauccccgagaccauccucgagcucaccgacgcccucgcccucggcaugauggcccucaagaucgucaagaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucgucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcuccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucacccgcauggccaucuccggcgacgacugcgucgucaagcccaucgacgaccgcuucgccaacgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11733 - RNA, 9876 nt, Artificial Sequence
  derived and/or modified CDS sequence (opt2) from DENV-2__FJ850076__SS-prME
accgccggcgccaucgucaugcucauccccaccgucauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaugauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcgucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcuccccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcgucgcccuccucucccaguccaccauccccgagaccauccucgagcucaccgacgcccucgcccucggcaugauggcccucaagaucgucaagaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacguccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucgucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcuccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucacccgcauggccaucuccggcgacgacugcgucgucaagcccaucgacgaccgcuucgccaacgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11734 - RNA, 9876 nt, Artificial Sequence
  derived and/or modified CDS sequence (opt2) from DENV-2__GQ868640__SS-prME
accgccggcgccaucgucaugcucauccccaccgucauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaugauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcgucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcuccccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaucaccgacgacaucggcaugggcgucaccuaccucgcccuccucgccgccuucaagguccgccccaccuucgccgccggccuccuccuccgcaagcucaccuccaaggagcucaugauggccaccaucggcgucgcccuccucucccaguccaccauccccgagaccauccucgagcucaccgacgcccucgcccucggcaugauggcccucaagaucgucaagaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacguccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucgucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcuccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucacccgcauggccaucuccggcgacgacugcgucgucaagcccaucgacgaccgcuucgccaacgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11735 - RNA, 9876 nt, Artificial Sequence
  derived and/or modified CDS sequence (opt2) from DENV-2__FJ850078__SS-prME
accgccggcgucaucgucaugcucauccccaccgucauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaugauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcgucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucaacggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcuccccaccgagucccacaaccagaccuuccucaucgacggccccgagaccgccgagugccccaacgccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcgucgcccuccucucccaguccaccauccccgagaccauccucgagcucaccgacgcccucgcccucggcaugauggcccucaagaucgucaagaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucgucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcuccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucacccgcggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucacccgcauggccaucuccggcgacgacugcgucgucaagcccaucgacgaccgcuucgccaacgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11736 - RNA, 9876 nt, Artificial Sequence
  derived and/or modified CDS sequence (opt2) from DENV-2__FJ850082__SS-prME
accgucggcgucaucgucaugcucauccccaccgccauggccuuccaccucaccacccgcaacggcgagccccacaugaucgucggccgccaggagaagggcaagucccuccucuucaagaccgagaacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcgucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccgucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcgucgcccuccucucccaguccaccauccccgagaccauccucgagcucaccgacgcccucgcccucggcaugauggcccucaagaucgucaagaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggagggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucgucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgacaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaucccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagaugaucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucacccgcauggccaucuccggcgacgacugcgucgucaagcccaucgacgaccgcuucgccaacgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11737 - RNA, 9876 nt, Artificial Sequence
  derived and/or modified CDS sequence (opt2) from DENV-2__FJ850085__SS-prME
accgucggcgucaucgucaugcucauccccaccgccauggccuuccaccucaccacccgcaacggcgagccccacaugaucgucggccgccaggagaagggcaagucccuccucuucaagaccgagaacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcgucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucgccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccgucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcgucgcccuccucucccaguccaccauccccgagaccauccucgagcucaccgacgcccucgcccucggcaugauggcccucaagaucgucaagaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggagggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucgucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgacaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaucccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagaugaucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucacccgcauggccaucuccggcgacgacugcgucgucaagcccaucgacgaccgcuucgccaacgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11738 - RNA, 9876 nt, Artificial Sequence
  derived and/or modified CDS sequence (opt2) from DENV-2__FJ850088__SS-prME
accgccggcgucaucgucaugcucauccccaccgucauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaugauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcgucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggaggucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucaacggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcuccccaccgagucccacaaccagaccuuccucaucgacggccccgagaccgccgagugccccaacgccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucucccucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcgucgcccuccucucccaguccaccauccccgagaccauccucgagcucaccgacgcccucgcccucggcaugauggcccucaaggucgucaagaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucgucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcuccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggcaaggccuacaaccacgcccucuccgagcuccccgagacccucgagacccuccuccuccucgcccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccgucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucacccgcggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaccuacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucucccgcaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucacccgcauggccaucuccggcgacgacugcgucgucaagcccaucgacgaccgcuucgccaacgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11739 - RNA, 9876 nt, Artificial Sequence
  derived and/or modified CDS sequence (opt2) from DENV-2__FJ850091__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcgccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgccaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11740 - RNA, 9876 nt, Artificial Sequence
  derived and/or modified CDS sequence (opt2) from DENV-2__GQ199890__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaucggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcgcgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccaccaucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcaccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgcaaggaggaggaggaggccggcguccucugguga

SEQ ID NO: 11741 - RNA, 9876 nt, Artificial Sequence
  derived and/or modified CDS sequence (opt2) from DENV-2__GQ868549__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaugggcaacgagggcuacaccgacuacaugcccuccaugaagcgcuuccgccgcgaggaggaggaggccggcguccucugguga

SEQ ID NO: 11742 - RNA, 9876 nt, Artificial Sequence
  derived and/or modified CDS sequence (opt2) from DENV-2__GQ868551__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggucaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaugggcaacgagggcuacaccgacuacaugcccuccaugaagcgcuuccgccgcgaggaggaggaggccggcguccucugguga

SEQ ID NO: 11743 - RNA, 9876 nt, Artificial Sequence
  derived and/or modified CDS sequence (opt2) from DENV-2__HM181971__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagaucgacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaugggcaacgagggcuacaccgacuacaugcccuccaugaagcgcuuccgccgcgaggaggaggaggccggcguccucugguga

SEQ ID NO: 11744 - RNA, 9876 nt, Artificial Sequence
  derived and/or modified CDS sequence (opt2) from DENV-2__GU131881__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaagaacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggcaaggccuacacccacgcccucuccgagcuccccgagacccucgagacccuccuccuccucacccuccucgccgccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccgucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11745 - RNA, 9876 nt, Artificial Sequence
  derived and/or modified CDS sequence (opt2) from DENV-2__FJ898461__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguuccagaccaccguccgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgucgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgccucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11746 - RNA, 9876 nt, Artificial Sequence
  derived and/or modified CDS sequence (opt2) from DENV-2__FJ024473__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaccuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcgacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcuaccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagaccacccucaccauccucauccgcaccggccuccucgucaucuccggcgucuuccccgucuccauccccaucaccgccgccgccugguaccucugggaggucaagaagcagcgcgccggcguccucugggacguccccucccccccccucgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccgucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgaggccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccgcccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11747 - RNA, 9876 nt, Artificial Sequence
  derived and/or modified CDS sequence (opt2) from DENV-2__FJ024474__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccucaagcagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaucggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcuaccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgccuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagauccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucacccacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccgucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccgcccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11748 - RNA, 9876 nt, Artificial Sequence
  derived and/or modified CDS sequence (opt2) from DENV-2__FJ024475__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcgacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcuaccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagaccacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccgucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaugacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccgcccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11749 - RNA, 9867 nt, Artificial Sequence
  derived and/or modified CDS sequence (opt2) from DENV-2__FJ182012__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcuaccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagauccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucacccacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccgucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccucucccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccgcccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11750 - RNA, 9876 nt, Artificial Sequence
  derived and/or modified CDS sequence (opt2) from DENV-2__EU854293__SS-prME
accgccggcaugaucaucaugcucauccccaccgucauggccuuccaccucaccacccgcaacggcgagccccacaugaucgucucccgccaggagaagggcaagucccuccucuucaagaccggcgacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaguccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacaugaagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacgagguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaugguccgcaagauggagaaguaccagcucgccgucaccaucauggccauccucugcguccccaacgccgucauccuccagaacgccuggaaggucuccugcaccauccucgccgucgucuccgucuccccccucuuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagauccucaccauccucauccgcaccggccuccucgucaucuccggccucuuccccgucuccaugcccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgcaagcucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccugguccuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccucuuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11751 - RNA, 9876 nt, Artificial Sequence
  derived and/or modified CDS sequence (opt2) from DENV-2__EU854294__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcuaccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccgucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccgcccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11752 - RNA, 9876 nt, Artificial Sequence
  derived and/or modified CDS sequence (opt2) from DENV-2__FJ024477__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgccacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgccgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11753 - RNA, 9876 nt, Artificial Sequence
  derived and/or modified CDS sequence (opt2) from DENV-2__GQ868552__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucgccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccuccccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggagaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcaucgcccucuuccucgaggagaugcuccgcacccgcgucggcaccaagcacgccauccuccucgucgccaucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgccgccucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccucaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccacgccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgagaacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuuccgcgccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucuccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11754 - RNA, 9876 nt, Artificial Sequence
  derived and/or modified CDS sequence (opt2) from DENV-2__GQ868553__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcaggucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgucggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccaucuucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagauccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuuccgcaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccgcccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11755 - RNA, 9876 nt, Artificial Sequence
  derived and/or modified CDS sequence (opt2) from DENV-2__GQ868554__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgucgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11756 - RNA, 9876 nt, Artificial Sequence
  derived and/or modified CDS sequence (opt2) from DENV-2__GQ868555__SS-prME
accgccggcgucaucgucaugcucauccccaccgccaucgccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgaggucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggagggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacaucgaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11757 - RNA, 9876 nt, Artificial Sequence
  derived and/or modified CDS sequence (opt2) from DENV-2__GQ868556__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaucgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucacccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugcgcaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11758 - RNA, 9876 nt, Artificial Sequence
  derived and/or modified CDS sequence (opt2) from DENV-2__GQ868557__SS-prME
accgccggcgucaucgucaugcucauccccaccgccaucgccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgaggucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaacgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11759 - RNA, 9876 nt, Artificial Sequence
  derived and/or modified CDS sequence (opt2) from DENV-2__GU131947__SS-prME
accgccggcgucaucgucaugcucauccccaccgccaucgccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccaugauccuccgcaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgaggucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggccgcgccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaucgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11760 - RNA, 9876 nt, Artificial Sequence
  derived and/or modified CDS sequence (opt2) from DENV-2__GQ868558__SS-prME
accgccggcgucaucgucaugcucauccccaccgccaucgccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccucaagcagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggccggcaagcgcucccuccgcccccagcccaccgagcucaaguacuccuggaagaccuggggcaaggccaagaugcacuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccgcaacgccuggaaggucuccugcaccauccucgccgccgucuccgucuccccccuccuccucaccuccucccagcagaaggccgacuggaucccccucguccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgaggucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacgccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaucgaggagaucgccguccagaacuggcucgccaaggucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11761 - RNA, 9876 nt, Artificial Sequence
  derived and/or modified CDS sequence (opt2) from DENV-2__KJ189305__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgccucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacacccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11762 - RNA, 9876 nt, Artificial Sequence
  derived and/or modified CDS sequence (opt2) from DENV-2__FJ898451__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgucaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccguccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11763 - RNA, 9876 nt, Artificial Sequence
  derived and/or modified CDS sequence (opt2) from DENV-2__HM488257__SS-prME
accgccggcaucaucaucaugaugauccccaccgucauggccuuccaccucaccacccgcaacggcgagccccacaugaucgucucccgccaggagaagggcaagucccuccucuucaagaccgagaacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgucaccggcgagcaccgccgcgagaagcgcuccgucgcccucgucccccacgucggcaugggccucgagacccgcaccgagaccuggauguccuccgagggcgccuggaagcacgcccagcgcaucgagaccuggguccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcaccccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaaggccuggggcaaggccaagaugcucuccaccgagcuccacaaccacaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggccgccucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuacgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccacccucgccauggucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcgucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucaccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccgccaacacccgccgcggcaccggcaacaccggcgagacccucggcgagaaguggaagcaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacuccggcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcaagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuuccgccucaccuaccagaacaaggucguccgcguccagcgccccaccccccgcggcaccgucauggacaucaucucccgccgcgaccagcgcggcuccggccaggucgucaccuacggccucaacaccuucaccaacauggaggcccagcucauccgccagauggagggcgagggcgucuucaaguccauccagcaccucaccgccaccgaggagaucgccgucaagaccuggcucguccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccacccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11764 - RNA, 9876 nt, Artificial Sequence
  derived and/or modified CDS sequence (opt2) from DENV-2__HQ999999__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacauccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccaucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaaggucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaccaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuuccucacccccaugcuccgccacuccaucgagaacuccuccgucaacgucucccucaccgccaucgccaaccaggccaccguccucaugggccucggcaagggcuggccccucuccaagauggacaucggcgccccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11765 - RNA, 9876 nt, Artificial Sequence
  derived and/or modified CDS sequence (opt2) from DENV-2__FJ898449__SS-prME
accgccggcaugaucaucaugcucauccccaccgucauggccuuccaccucaccacccgcaacggcgagccccacaugaucgucucccgccaggagaagggcaagucccuccucuucaagaccaaggacggcaccaacaugugcacccucauggccauggaccucggcgagcucugcgaggacaccaucaccuacaagugccccuuccucaagcagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccaucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgacucccgcugccccacccagggcgagcccacccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccgucgucaucaccccccacuccggcgaggagcacgccgucggcaacgacaccggcaagcacggcaaggaggucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucgacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucgucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucaccuccgagcucaaccacauccucuccgagaacgaggucaagcucaccaucaugaccggcgacaucaagggcaucaugcaggucggcaagcgcucccuccgcccccagcccaccgagcuccgcuacuccuggaagaccuggggcaaggccaagaugcucuccaccgagcuccacaaccagaccuuccucaucgacggccccgagaccgccgagugccccaacaccaaccgcgccuggaacucccucgaggucgaggacuacggcuucggcgucuucaccaccaacaucuggcuccgccuccgcgagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacaaccgccccggcuaccacacccagaccgccggccccuggcaccucggcaagcucgagauggacuucgacuucugcgagggcaccaccgucgucgucaccgaggagugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucuccucccucgucaccgccggccacggccagaucgacaacuucucccucggcauccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccuccauccccgagaccauccucgagcucaccgacgcccucgcccucggcaugaugguccucaagaugguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggacgaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuuccgcaccaacaccggcaccaucggcgccgucucccucgacuucucccccggcaccuccggcucccccaucgucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagaaguaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaagaccggcaacgacaucgccgccugccuccgcaagaacggcaagcgcgucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaacccccgcaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccuccgagggcaucaacuacgccgaccgccgcuggugcuucgacggcacccgcaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucaucaucgccauccucaccgucgucgccgccaccauggccaacgagaugggcuuccucgagaagaccaagaaggaccucggccucggccacaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccgucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucgucccccccgagcgcugcgacacccuccucugcgacaucggcgaguccucccccaaccccaccgucgaggccggccgcacccuccgcguccucaaccucgucgagaacuggcucaacaacaacacccaguucugcgucaagguccucaaccccuacaugcccuccgucaucgagcgcauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgaggccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucaccaagaagguccgcuccaacgccgcccucggcgccaucuucaccgacgagaacaaguggaaguccgcccgcgaggccgucgaggacaaccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucaccaucgaggaccucaagaacgaggagaugaucaccaaccacauggccggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccuccgaggagaucgccguccaggacuggcucguccgcgucggccgcgagcgccucucccgcauggccaucuccggcgacgacugcgucgucaagccccucgacgaccgcuucgcccgcgcccucaccgcccucaacgacaugggcaagguccgcaaggacauccagcagugggagcccucccgcggcuggaacgacuggacccagguccccuucugcucccaccacuuccacgagcucaucaugaaggacggccgcacccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccucccacgaguggaugaccaccgaggacaugcucaccgucuggaaccgcgucuggauccucgagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11766 - RNA, 9876 nt, Artificial Sequence
  derived and/or modified CDS sequence (opt2) from DENV-2__FJ906966__SS-prME
accgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugccccuuccucaagcagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgacucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggccucaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagaugaucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaucaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccagccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaugguccgcaagauggagaaguaccagcucgccgucaccaucauggccauccucugcguccccaacgccgucauccuccagaacgccuggaaggucuccugcaccauccucgccgucgucuccgucuccccccucuuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgcaagcucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccugguccuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccucuuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgccaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11767 - RNA, 9876 nt, Artificial Sequence
  derived and/or modified CDS sequence (opt2) from DENV-2__FJ906968__SS-prME
accgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugccccuuccucaagcagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgacucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacaugaagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagaugaucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaucaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccagccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacgagguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaugguccgcaagauggagaaguaccagcucgccgucaccaucauggccauccucugcguccccaacgccgucauccuccagaacgccuggaaggucuccugcaccauccucgccgucgucuccgucuccccccucuuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagauccucaccauccucauccgcaccggccuccucgucaucuccggccucuuccccgucuccauccccaucaccgccgccgccuggugccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgcaagcucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccugguccuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccucuuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11768 - RNA, 9876 nt, Artificial Sequence
  derived and/or modified CDS sequence (opt2) from DENV-2__FJ906969__SS-prME
accgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugccccuuccucaagcagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgacucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacaugaagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaucaugaagauccucaucggcgucaucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccagccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaugguccgcaagauggagaaguaccagcucgccgucaccaucauggccauccucugcguccccaacgccgucauccuccagaacgccuggaaggucuccugcaccauccucgccgucgucuccgucuccccccucuuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagauccucaccauccucauccgcaccggccuccucgucaucuccggccucuuccccgucuccauccccaucaccgccgccgccuggugccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacgccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgcaagcucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccugguccuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccucuuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11769 - RNA, 9876 nt, Artificial Sequence
  derived and/or modified CDS sequence (opt2) from DENV-2__FJ898454__SS-prME
accgccggcgucaucaucaugcucauccccaccgccauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggccuacgaggagggcaucugcggcauccgcuccgucacccgccucgagaaccucauguggaagcagaucacccccgagcucaaccacauccucuccgagaacgaggccaagcucaccaucaugaccggcgacaucaagggcaucaugcaggccggcaagcgcucccuccgcccccagcccaccgagcucaaguacuccuggaagaccuggggcaaggccaagaugcucuccaccgagccccacaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaagaacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccguccuccucgucgccgucuccuucaugacccucaucaccggcaacauguccuuccgcgaccucggccgcgucauggucauggucggcgccgccaucaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugauccucaagaucguccgcaacauggagaaguaccagcucgccgucaccaucauggccacccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagcgcgacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaccggcgagacccucggcgagaaguggaagaaccgccucaacucccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagaucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacaugggcgcccagcucauccgccagauggagggcgagggcgucuucaagggcauccagcaccucaccgccaccgaggaggucgccguccaggacuggcucgcccgcgucggccgcgagcgccucucccgcauggccaucuccggcgacgacugcgucgucaagccccucgacgaccgcuucgccuccgcccucaccgcccucaacgacaugggcaagauccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgcccgccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcuccgaggaguacaccgacuacaugcccuccaugaagcgcuuccgccgcgaggaggaggaggccggcguccucugguga

SEQ ID NO: 11770 - RNA, 9876 nt, Artificial Sequence
  derived and/or modified CDS sequence (opt2) from DENV-2__JQ922551__SS-prME
accgucggcaugaucaucaugcucauccccaccgccauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaacugcccccuccucaagcagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccugcaagcacgcccagcgcaucgagaccuggauccuccgccaccccuccuucaccaucauggccgccauccucgccuacaccaucggcaccaccuacuuccagcgcgucgucuuccucaugguccucaccgccgucgcccucuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucguccgcaagcacuccauggucgaccgcggcuggggcaacggcugcggccucuucggcaagggcggcaucgucaccugcgccauguucaccugcaagaagaacauggagggcaagaucguccagcccgagaaccucgaguacacccucgucaucaccccccacuccggcgaggagaacgccgucggcaacgacaccggcaaccacggcaaggagaucaaggucaccccccaguccuccaucaccgaggccgcccucaccggcuacggcaccgucaccauggagugcuccccccgcaccggccucaacuuccacgagauggucucccuccccauggagaacaaggccuggaugguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucuggggcaucgcccgcacccagcacggcaccaucguccaccgcguccaguacgagggcgacggcucccccugcaagaucccccucaacaucaugggccucgagaagcgccacguccucggccgccccaucaccgucaaccccaucgucaccggcaaggacucccccgucaacaucgaggccgagcccccccucggcgacuccuacaucaucaucggcgucgagcccggccaggucaagcucaccugcucccagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucgucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagccccacaaccagaccuuccucaucgacggccccgagaccgccgagugccccuccaccaaccgcgccuggaacucccucaagggcggcgacuacggcuucggcgucuucaccaccaacaucuggcucaagcucaaggagcgccaggacgucuccugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaaccucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccgagcacgagcagaucgacaacuucucccucggcguccucggcauggcccucuuccucgaggagaugcuccgcacccgcgucggcaccaagcacgccguccuccucgucgccgucuccuucaugacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugauccucaagaucguccgcaacauggagaaguaccagcucgccgucaccaucauggccauccucugcguccccaacgccaugauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuaccuccuccccggccgcuccgccgaccucgagcucgagcgcgccgccgaccuccgcugggaggaccaggccgagaucuccggcuccucccccauccucuccaucaccaucuccgaggacggcuccauguccaucaagaaccaggaggagaagcagacccucaccauccucaucaagaccggccuccucgucaucuccgagcucuuccccguccagauccccaucaccgccgccgccugguaccucugggaggucaagaagcagcgcgccggcguccucugggacguccccucccccccccccgucggcaaggccgagcucgaggacggcgccuacggcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagacccgccccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagaagaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgccgucgccgccaccauggccaacgagaugggcuuccucgagaagaccaagaaggacuucggccucggcuccaucgccacccagccccccgaguccaacauccucgacaucgaccuccgccccgccuccgccuggacccucuacgccgucgccaccaccuucaucaccuccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcgucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaguccgacacccgcacccaggagcccaaggagggcaccaagaagcucaugaagaucacccccaaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagaugggcgccaaccaccucgagggcgagcccaagaagcucuacgaggccaucuucaagcucaccuaccagaacaagggcguccgcguccagcgccccaccccccgcggcccccucauggacaucauccuccgccgcgaccagggcggcuccggccaggucggcaccuacggccucaacaccuucaccaacaugggcgcccagcucauccgccagauggagggcgagggcgucuucaagggcauccagcaccucaucgccaccgaggagaucgccguccaggacuggcucgcccgcgucggccgcgagcgcuucucccgcauggccaucuccggcgacgacugcgucgucaagccccucgacgaccgcuucgccuccgcccucaccgcccucaacgacaugggcaaggagcgcaagguccuccagcagugggagcccucccgcgaguggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccagauguacuuccaccgccgcgaccuccgccucgccgccaacgccaucugcuccgccguccccucccacuggguccccaccucccgcaccaccugguccauccacgcccgccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11771 - RNA, 9876 nt, Artificial Sequence
  derived and/or modified CDS sequence (opt2) from DENV-2__JQ922550__SS-prME
accgucggcaugaucaucaugcucauccccaccgucauggccucccaccucaccacccgcaacggcggcccccacaugaucgucaucggccagcagaagcgcaagaccuccuucuucaagaccaagaagggccacgacaugugcacccucauggccauggccuucggcgaguucugcgagaacaccaucaccuacaagugccccuuccucaagcagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccaucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgacucccgcugccccacccagggcgagcccacccucaacgaggagcaggacaagcgcuucgucugcaagcacuccauggucgaccgcggcuggggcaacggcugcggccucuucggcaagggcggcaucgucaccugcgccauguucaccugcaagaagaacaugaagggcaagaucguccagcccgagaaccucgaguacaccgucgucaucaccccccacuccggcgaggagcacgccgucggcaacgacaccggcaagcacggcaaggaggucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucaaggaccucgagaagcgccacguccucggccgccucaucaccgucaaccccaucgucaccgagaaggacucccccgucaacaucgaggccgagcccccccucggcgacuccuacaucaucaucggcgucgagcccggccagcucaagcucgacugguucaagaagggcuccuccaucggccagauguucgagaacaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcggcggcugcgagcgcaagaccaagaccaagugcggcuccggcaucuucgucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcuccgcuacuccuggaagaccuggggcaaggccaagaugcucuccaccgagcuccacaaccagaccuuccucaucgacggccccgagaccgccgagugccccaacaccaaccgcgccuggaacucccucgaggucgaggacuacggcuucggcgucuucaccaccaacaucuggcuccgccuccgcgagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucuggggcaacggcguccucgaguccgagauggucauccccaagaacuucgccggccccgucucccagcacaacaaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccccaaguaccgcggcgaggacggcugcugguacggcauggagauccgcccccucaaggagaaggaggagaaccucgucuccucccucgucaccgccggccacggccagaucgacaacuucucccucggcauccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccucuccucccaguccuccauccccgagaccauccucgagcucaccgacgcccucgcccucggcaugaugguccucaagaugguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucuccggcaccuccaagcgccgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggacgaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccucgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuuccgcaccaacaccggcaccaucggcgccgucucccucgacuucucccccggcaccuccggcucccccaucgucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaagaccggcaacgacaucgccgccugccuccgcaagaacggcaagcgcgucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagacccuccucgagcucauccgcggcggccccauccccgucuaccucggcuacaaguggcccggcgagggcaucaacuacgccgacucccgccucugcgucggccgcacccagaacaaccagauccucgaggagaacgucgaggucgagaucuggaccaaggagggcaagggcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucaucaucgccauccucaccgucgucgccgccaccauggccaacgagaugggcuuccucgagaagaccaagaaggaccucggccucggcaacaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccgucuccacccucugggagggcaaccccggccgcuucuggaacaccaccauccucauccagauggccaacauccuccgcggcuccuaccucgccggcgccggcccccucuucuccaucauggagaacaccaccggcccccgccgccgcaccggccagcucggccgcgagcuccuccgccgcuggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagcgcugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcauccaggagcccaaggagggcaccaagaagcucaugaagaucauggccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucacccucggcgcccucaagaacgagcgcaagugcaccgagcacauggagggcgagccccgcaagcccggccgcggccacuucaaguggcgcaaccagaaccgcgucgucggcguccagggccccacccccggcggcaccgucauggacaucaucucccgcaagaaccagcgcggcuccggccaggucggcaccuacggccucaacaccuucaccaacauggaggcccagcucauccgccagauggagggcgagggcuucuucaucgagcaccagcaccucaccgccuccgaggagaacgccguccaggacuggcucgcccgcgucggccgcgagaaggucucccgcaugcccaucuccggcgacgacugcgucgucaagccccucgacgaccgcuucgcccgcgcccucaccgcccucaacgacaugggcaagguccgcaaggacauccagcagugggagcccucccgcggcuggaacgacuggacccagguccccuucugcucccaccacuuccacgagcucaucaugaaggacggccgcacccucgucguccccugccgcaaccaggacgagcucaucggccgcgcccgcaucucccagggcgccggcugguccuucggcgagaccgccugccucggcaaguccuacgcccagauguggucccucaucaacuuccgcauccccgaccuccgccucgccgccaacgucaucugcuccgucguccccucccacuggguccccaccucccgcaccaccugguccauccacgccaaccacgaguggaugaccaccgaggacaugcucaccgucuggaaccgcgucuggauccucgagaaccccuggauggaggacaagacccccgucgaguccugggaggagauccccuaccucgagaagcgcgaggaccaguggugcggcucccucaucggccucaccccccagccccccugggccaagaacaucgagaccgccaucaaccagguccgcucccucaucggcaacgaggaguacaucgacuaccuccccuccaugaagcgcuuccgcaucgaggaggaggaguccggcuuccucugguga

SEQ ID NO: 11772 - RNA, 9876 nt, Artificial Sequence
  derived and/or modified CDS sequence (opt2) from DENV-2__JQ922553__SS-prME
accgccggcaugaucaucaugcucauccccaccgucauggccuuccaccucaccacccgcaacgucgagccccccaugaucuucucccgccaggagaagggcaaguccuuccucuucaagaccaaggacggccacgacaugugcaccuucauggccauggaccucggcgagcucugcgaggacaccaucaccuacaagugccccuuccucaagcagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcguccucaucuucauccuccucaccggcgucgcccccuccaugcgcaugcgcugcaucggcaucuccaaccgcgacuucgucgagggcgucuccggcggcuccugggucgacaucguccucgagcacggcuccugcgucaccaccauggccaagaacaagcccacccucgaccucgagcucaucaagaccgaggccaagcagcccgccacccuccgcaaguacugcaucgaggccaagcucaccaacaccaccaccgacucccgcugccccacccagggcgagcccacccucaacgaggagcaggacaagcgcuucgucugcaagcacuccauggucgaccgcggcuggggcaacggcugcggccucuucggcaagggcgccaucgucaccugcgccauguucaccugcaagaaguccaugaagggcaagaucguccagcccgagaaccucgaguacaccgucgucaucaccccccacuccggcgaggaguacgccgucggcaacgacaccggcaagcacggcaaggaggucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucgacugguucaagaagggcuccuccaucggccagaugcucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucgucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccucgagcucaaccacauccucuccgagaacgaggucaagcucaccaucaugaccggcgacaucaagggcaucaugcaggucggcaagcgcucccuccgcccccagcccaccgagcuccgcuacuccuggaagaccuggggcaaggccaagaugcucuccaccgagcuccacaaccagaccuuccucaucgacggccccgagaccgccgagugccccaacgccaaccgcgccuggaacucccucgaggucgaggacuacggcuuccgcaaguacaagaccaagaucuggcccacccucaaggaguggcgcaaggucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucuggggcaacggcguccaggaguccgagauggucauccccaagaacuucgccggccccgucucccagcacaacaaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggccggcugcugguacuggauggacauccgcccccucaaggagaaggagaagaaccucgucuccucccucgucaccgccggccacggccagaucgacaacuucucccuccgcauccucggcauggcccucuuccucgagaagaugcucaugacccgccucggcaccaagcacgccauccuccucgucgccgucuccuucgucacccucaucacccgcaacauguccuucaaggaccucggccgcgucauggucauggucggcgccaccaugaccgacgacaugcgcaugggcgucaccuaccucgcccuccuccccgccuucaagguccgccccaccuucgccaccggccuccuccuccgcaagcucaccuccaaggagcucaugaugaccaccaucggcaucguccucuucucccaguccuccauccccgagaccauccucgagcucaccgacgcccucgcccucggcaugaugguccucaagaugguccgcaacauggagaaguaccagcucgccgucaccaucauggccauccucugcguccccaacgccgucauccuccagaacgccuggcgcgucuccugcaccauccucgccgucgucuccgucuccccccucuuccucaccuccucccgccagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggacgaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcauccagcagaagggcaucuucggcuacucccagaucggcgccggcgucuacaaggagggcaccuuccccaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcgccuacgucuccgccaucgcccagaccgagaaguccaucgaggacuaccccgaggucgagauggacaucuuccgcaagaagcgccucaccaucauggacuuccaccccggcgccggccgccagaagcgcuacuuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaucgucugguucguccccucccucaagaccggcaaguacaucgccgccugccuccgcaagaacggcaagcgcgucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagacccuccucgagcucauccgcggcggccccauccccgucuaccucggcuacaaguggcccggcgagggcaucaacuacgccgacucccgccucugcuucgacggcaucaagaacaaccagauccucgaggagaacgucgaggucgagaucuggaccaaggagggcgagcgcaaggagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcggcgcccucgccucccucaugguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaccguccuccucauccccgagcccgagaagcagcgcaccccccaggacaaccagcucaccuacgucaucaucgccauccucaccgucgucgccgccaccauggccaacgagaugggcuuccucgagaagaccaagaaggaccucggccucggcaacaucgccacccagcaguccugcaagaagauccucgacaucuaccucggccccgcccuccccuggaagcucuacgccggcggcaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccucuuccuccucgucgcccacuacgccaucaucggccccggccuccaggccaagcccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccgucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgacgagcgcaaccucgucacccccgagggcaaggucgucgaccucggcugcggccgcggcggcugguccuucuucugcggcggccucaagaacguccgcgaggucaaggcccucaccaucggcggccccggccacgaggagcccauccucauguccaccuacggccgcaaccucguccgcucccaguccggcgucgucgucuuccacaccccccccgagaagugcgacaccucccuccgcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccuggggcucccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaucaagaagguccgcuccaacgccgcccucggcgccaucuucaccgacgagaacaaguggaaguccgcccgcgaggccgucgaggacggccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucacccucgaggaccucaagaacgaggagcgcaagaccaaccacaugggcggcgagcaccgcaagcucgcccgcggcaucuucaagaugaaccucaccaacaaggucguccgcguccagcgccccacccccggcggcacccucauggacaucaucucccgcaagacccagcgcggcuccgagcaggucggcaccuacggccucaccacccucaccaaccucgaggccccccccauccgccagauggagggcaagggcgucuucaagggccaccagcaccgcaccgccuccgaggagaacgccguccaggacuggcucgcccgcgucggcggcgagcgccucucccgccucgccaucuccggcgacgacugcgucgucaagccccucgacgaccgcuucgcccgcgcccucaccgcccucaacgacaugggcaagguccgcaaggacauccagcagugggagcccucccgcggcuggaacgacuggacccagguccccuucugcucccaccacuuccacgagcucaucaugaaggacggccgcacccucgucguccccugccgcaaccaggacgagcucaucggccgcgcccgcaucucccagggcgccggcuggucccuccgcgagaccgccugccucggcaaguucuacgcccagcgcuggucccucauguacuuccaccgccgcgaccuccgccucgcccccaacgccaucugcuccgccguccgcacccacuggguccccaccucccgcaagaccuggcccauccacgccucccacgacuggaugaccaccgaggucaugcucaccgucuggaacaagcucugguuccaggagaaccccuggauggaggacaagacccccgucggcuucugggaggagauccccuuccucgagaagggcaaggaccaguggggcggcucccucaucggccucaccucccgcccccccugggccaagaacuuccagcccgccaucaaccagguccgcucccuccucugcaacgaggaguccgccgacuucaugcccuccaugaagcgcuuccgccgcgaggaggaggaggccggcguccucugguga

SEQ ID NO: 11773 - RNA, 9876 nt, Artificial Sequence
  derived and/or modified CDS sequence (opt2) from DENV-2__JQ922549__SS-prME
accgccggcgucaucaucaugcucauccccaccgccauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgcccccggcgaccaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucauccucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccucaccaaguacugcaucgaggccaagcucaccaacaccaccaccgccucccgcugccccacccagggcgagcccucccucaacgaggagcagcacaagcgcuucgucugcaagcacuccauggucgaccgcggcuggggcaacggcugcggccucuucggcaagggcggcaucgucaccugcgccauguucaccugcaagaagaacaugaagggcaagaucguccagcccgagaaccucgaguacaccaucgucgucaccccccacuccggcgaggagaacgccgucggcaacgacaccggcaagcacggcaaggagaucaagguccgcccccaguccuccaucaccgaggccgagcucaccggcuacggcaccgucaccauggagugcuccccccgcaccggcuucgccuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccucguccucggccgccucaucaccgucaaccccaucgucaccgagaaggacucccccgucaacaucgaggccgagccccccuucggcgacuccuacaucaucaucggcgucgagcccggccagcucaagcccuccugguucaagaagggcuccuccauccgccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaccaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagccccacaaccagaccuuccucaucggcggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuuccacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucgagggcgaggagggcgaccucguccacucccucgucaccgccggccacggccagaucgacaacuucucccucggcguccucggcauggcccucuuccucgaggagaugcuccgcacccgcgucggcaccaagcacgccguccuccucgucgccgucuccuucaugacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggccgcaugauccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucgagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaaguacgaggaggaggagcccacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuccucccagaucggcgcccgcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcaccgucucccucgacuucucccccggcaccuccgagucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacucccccgucaacgucucccucaccgccaucgccaaccaggccaccguccucaugggccucggcaagggcuggccccucuccaagauggacaucggcguccccccccucgccaucggcugcuacucccaggucaaccccaucacccucaccgccgcccuccuccuccucgucgcccacuacgccaucaucggccccggccuccaggucaaggccacccgcgaggcccagaagcgcgccgccgccggcaucaugaagaaccccaccgucgacggcaucaccgucaucgaccucgaccccauccccuacgaccccaaguucgagaagcagcucggccagaucaugcuccgcguccucugcgucacccagguccucaugaugcgcaccaccugggcccucugcgaggcccucacccucgccaccggccccaucuccacccucugggagggcaaccccggccgccucggcaacaccaccaucgccgucuccauggccaacaucuuccgcggcuccuaccucgccggcgccggccuccucuucuccaucaugaagaacaccaccaacacccgccgcggcaccuccaaccucggcgagacccucggcgagaaguggaagaaccgccucaacucccucggcaaguccgaguuccagaucuacaagaaguccggcauccaggaggucgaccgcacccucgccaaggagggcaucaagaagggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgaggacgucuucuucaccccccccgagaagugcgacacccuccucugcgacaucggcgaguccucccccaaccccaccgucgaggccggccgcacccuccgcguccucaacauggucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccucccucgucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucucccgcaagguccgcuccaacgccgcccucggcgccaucuucaccgacgagaacaaguggaaguccgcccgcgaggccgucgaggacggccgcuucugggagcucgucgacaaggagcgcauccuccaccucgagggcaagugcgagaccugcgucuacaacaugaugggcaagcgcgagaagaagaucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacaugggcgcccagcucauccgccagauggagggcgagggcgucuucaagggcauccagcaccucaccgccaccgaggagaucgccguccaggacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccacccgcuccauccacgcccgccaggaguggaugaccaccgaggucaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcuccgaggaguacaccgacuacaugcccuccaugaagcgcuuccgccgcgaggaggaggaggccggcguccucugguga

SEQ ID NO: 11774 - RNA, 9876 nt, Artificial Sequence
  derived and/or modified CDS sequence (opt2) from DENV-2__JQ922552__SS-prME
accgccggcaugaucaucaugcucauccccaccgucauggccuuccaccucaccacccgcaacggcgagccccccaugaucgucucccgccaggagaagggcaagucccuccucuucaagaccgaggacggcgucaacaugugcgcccucauggccauggaccucggcgagcgcugcgaggacaccaucaccuacaacugcccccuccucaaccagaacgagcccgaggacaucgacugcuggugcaacuccaccuccaccugggucaccuacggcaccugcaccaccaccggcgagcuccgccgcgagaagaucuccgucgcccucgucccccacgucggcaugggccucgagacccgcaccgagaccuggauguccuccgagggcgccuggaagcacgcccagcgcaucgagaucuggauccuccgccaccccggcuucaccaucauggccgccauccucgccuacaccaucggcaccucccacuuccagcgcguccucaucuucauccuccucaccgccaucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgacucccgcugccccacccagggcgagcccacccucaacgaggagcaggacaagcgcuucgucugcaagcacuccauggucgaccgcggcuggggcaacggcugcggccucuucggcaagggcggcaucgucaccugcgccauguucaccugcaagaagaucaugaagggcaagaucguccagcccgagaaccucgaguacaccgucgucaucaccccccacuccggcgaggagcacgccgucggcaacgacaccggcaagcacggcaaggaggucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagaugcucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaccggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucgucaccgacaacguccacaccuggaccgagcaguacauguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggucggcaagcgcucccuccgcccccagcccaccgagcuccgcuacuccuggaagaccuggggccagcccaagaugcucucccccgagcuccaccaccagaccuuccucaucgacggccccgagaccgccgagugccccaacaccaaccgcaccugggacucccucgaggucgaggacuacggcuucggcgucuucaccaccaagaucuggcuccgccuccgcgagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaugggcguccucgaguccgagauggucauccccaagaacuucgccggccccgucucccagcacaaccaccgccccggcauccccacccagaccgccggccccuggcaccucggcaagcucgagauggacuucgacuucugcgagggcaccaccgucgucgucaccgaggacugcggcaaccgcggccccucccuccgcaccuccaccgccuccggcaagcucaucaccgaguggugcugccgcuccugcacccuccccccccuccgcuaccgcggcgaggacggcugcugguacggcauggagauccgcccccucaaggagaaggaggagaaccucgucuccucccucgucaccgccggccacggccagaucgacaacuucucccucggcauccucggcauggcccucuuccucgaggagaugcuccgcacccgcgucggcaccaagcacgccauccuccucgucgccgucuccuucgucacccucaucaccggcaacauguccggccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccuccauccccgagaccauccucgagcucaccgacgcccucgcccucggcaugaugguccucaagaugguccgcaacauggagaaguaccagcucgccgucaccaucauggccauccucugcguccccaacgccgucauccuccagaacgccuggaaggucuccugcaccauccucgcccucgucuccgucuccccccucuuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggacgaccaggccgagaucuccggcuccucccccauccucuccaucaccaucuccgaggacggcuccauguccaucaagaacgaggaggaggagcagacccucaccauccucauccgcaccgagcuccucgucaucuccggccucuuccccaucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcgccuacgucuccgccaucgcccagaccgagaaguccaucgaggacaaccccgagaucgaggacgacaucuuccgccgcaagaagcucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaagaccggcaacgacaucgccgccugccuccgcaagaacggcaagcgcgucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcggccccgccgagggcaucaacuacgccgaccgccgcuggugcuucgacggcaucaagaacucccaguuccucgaggagaacgucgaggucgagaucuggcccuccggcggcgagcgcaaggagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucaucaucgccauccucaccgucgucgccgccaccauggccaacgagaugggcuuccucgagaagaccaagaaggaccucggccucggcaacaucgucacccagcagcccgaguccaacauccucgacaucgaccuccgccccgccuccgccuggacccucuacgccgccgccaccaccuucaucacccccaugcuccgccacuccaucgagaacuccuccgucaacaugucccucaccgccaucgccaaccaggccaccguccucaugggccucggcaagggcuggccccucuccaagauggacaucggcgucccccuccucgccaucggcugcuacucccaggucaaccccaucacccucaccgccgcccucuuccuccucgucgcccacuacgccaucaagggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccgucuccacccucugggagggcaaccccggccgcuucuggaacaccaccaucgccgucuccauggccaacaucuuccgcggcuccuaccucgccggcuccucccaggucuggcccuccaucaacaaccucaagggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcccccgcgaggaguucaccaagaagguccgcuccaacgccgcccucggcgccaucuucaccgacgccaccaaguggaaguccgcccgcgaggccgucgaggacggccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgagguccgcaagaaggagggcggcgccauguacgccgacgacuccgccggcugggacacccgcaucacccucgaggaccucaagaacgaggagcgcaucaccaaccacauggaggucgagcacaagaagcucgccgucggccacuucauccucaccuaccccaacaaggucguccgcguccagcgccccacccccgucggcaccgucauggacaucaucucccgcaagucccagcgcggcuccggccaggucggcaccuacggccucaacaccuucaccaaccucgagggcccccgcauccgccagauggagggcgaggaguccuucaagucccaccagcuccagaccgccaccgagcgcaacgccguccaggacuggcucgcccgcgucggccgcgagcgccucucccgcauggccaucuccggcgacgacugcgucgucaagccccucgacgaccgcuucgcccgcgcccucaccgcccucaacgacaugggcaagguccgcaaggacauccagcagugggagcccucccgcggcuggaacgacuggacccagguccccuucugcucccaccacuuccacgagcucaucaugaaggacggccgcacccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccucccacgagugggucgccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11775 - RNA, 9876 nt, Artificial Sequence
  derived and/or modified CDS sequence (opt2) from DENV-2__GU131896__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgccuccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccgucggcaaggcccuccaccagaucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaccgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcgacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgaccgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaccuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgccaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11776 - RNA, 9876 nt, Artificial Sequence
  derived and/or modified CDS sequence (opt2) from DENV-2__GU131897__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcauggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucaucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucauggacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaaggaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggccgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11777 - RNA, 9876 nt, Artificial Sequence
  derived and/or modified CDS sequence (opt2) from DENV-2__GQ868631__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaagggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcauggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgucgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugauggccaccaucggcaucguccuccucucccaguccaccauccccgagaccguccucgagcucaccgacgcccucgcccucggcaugauggcccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggccaugcagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaaggaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggccgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11778 - RNA, 9876 nt, Artificial Sequence
  derived and/or modified CDS sequence (opt2) from DENV-2__GU131899__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccgucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaugggcgagacccucggcgagaaguggaagucccgccucaacgcccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11779 - RNA, 9876 nt, Artificial Sequence
  derived and/or modified CDS sequence (opt2) from DENV-2__GU131900__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcauggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaaggacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaaggaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggccgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11780 - RNA, 9876 nt, Artificial Sequence
  derived and/or modified CDS sequence (opt2) from DENV-2__GU131901__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcauggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaaggaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggccgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11781 - RNA, 9876 nt, Artificial Sequence
  derived and/or modified CDS sequence (opt2) from DENV-2__GU131902__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcauggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucgccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaaggaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggccgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11782 - RNA, 9876 nt, Artificial Sequence
  derived and/or modified CDS sequence (opt2) from DENV-2__GU131924__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcauggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaagaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaaggaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagaucgucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggccgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11783 - RNA, 9876 nt, Artificial Sequence
  derived and/or modified CDS sequence (opt2) from DENV-2__GQ868638__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgccuccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccgucggcaaggcccuccaccagaucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaccgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcgacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgaccgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaccuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcgcccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuuccgcaacauccagcaccucaccgccaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11784 - RNA, 9876 nt, Artificial Sequence
  derived and/or modified CDS sequence (opt2) from DENV-2__GU131927__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggcccgcaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccgucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggccgccgcucccuccgcccccagcccaccgagcucaaguacuccuggaagaccuggggcaaggccaagaugcucuccaccgaguccuacaaccagaccuuccucaucgacggccccgagaccaccgagugccccaacgccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagucccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaccgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacaccucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccacccagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11785 - RNA, 9876 nt, Artificial Sequence
  derived and/or modified CDS sequence (opt2) from DENV-2__GU131928__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcauggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgucgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaaggaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggccgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11786 - RNA, 9876 nt, Artificial Sequence
  derived and/or modified CDS sequence (opt2) from DENV-2__GU131929__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccauccgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcauggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgucgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuucaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaaggaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggccgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11787 - RNA, 9876 nt, Artificial Sequence
  derived and/or modified CDS sequence (opt2) from DENV-2__GU131930__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggaguccaaggccuggcucguccaccgccagugguuccucgaccucccccuccccuggcuccccggcgccgacaagcagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaccgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcaccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcgacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacaccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaccuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgccaccgaggaggucgccgucaagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11788 - RNA, 9876 nt, Artificial Sequence
  derived and/or modified CDS sequence (opt2) from DENV-2__GU131931__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgcccacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcauggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccagaucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaaggaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggccgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11789 - RNA, 9876 nt, Artificial Sequence
  derived and/or modified CDS sequence (opt2) from DENV-2__GU131932__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcauggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaaggaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggccgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11790 - RNA, 9876 nt, Artificial Sequence
  derived and/or modified CDS sequence (opt2) from DENV-2__GQ199892__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcgcccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucgucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcauccucggcauggcccucuuccucgaggagaugcuccgcacccgcgucggcaccaagcacgccauccuccucgucgcccucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccacccuccccgagaccauccucgagcucaccgacgcccucgcccucggcaugauggcccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggucggcggccgcgccuacacccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacgucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgagggcuacaccgacuacaugcccuccaugaagcgcuuccgccgcgaggaggaggaggccggcguccucugguga

SEQ ID NO: 11791 - RNA, 9876 nt, Artificial Sequence
  derived and/or modified CDS sequence (opt2) from DENV-2__JF730044__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaaggagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccuccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaugggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccgucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucggcaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11792 - RNA, 9876 nt, Artificial Sequence
  derived and/or modified CDS sequence (opt2) from DENV-2__FJ639697__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaaggagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccuccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaugggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccgucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcucgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucggcaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcaccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11793 - RNA, 9876 nt, Artificial Sequence
  derived and/or modified CDS sequence (opt2) from DENV-2__FJ639698__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaaggagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucuccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucaucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgucuucugcgaccccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagggcuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucuccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaagaacgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccaaguggcucuggaaggagcucggcaagaagaagaccccccgcaucugcacccgcgaggaguucaccaagaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgucaccgaggaggucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11794 - RNA, 9876 nt, Artificial Sequence
  derived and/or modified CDS sequence (opt2) from DENV-2__FJ639699__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaaggagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucuccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucaucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagggcuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugauccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaagaacgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccaaguggcucuggaaggagcucggcaagaagaagaccccccgcaucugcacccgcgaggaguucaccaagaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccaguaccucaccgucaccgaggaggucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11795 - RNA, 9876 nt, Artificial Sequence
  derived and/or modified CDS sequence (opt2) from DENV-2__FJ639700__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaaggagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucuccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucaucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggccaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagggcuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugauccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggucggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaagaacgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccaaguggcucuggaaggagcucggcaagaagaagaccccccgcaucugcacccgcgaggaguucaccaagaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcaucuucaaguccauccaguaccucaccgucaccgaggaggucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11796 - RNA, 9876 nt, Artificial Sequence
  derived and/or modified CDS sequence (opt2) from DENV-2__GQ868620__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgucguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucaucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacgccaacaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacgacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccugguacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucauccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucgagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11797 - RNA, 9876 nt, Artificial Sequence
  derived and/or modified CDS sequence (opt2) from DENV-2__FJ639702__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaaggagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccuccaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaugggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucaucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuacuacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucucccucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcuccaaggaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcgucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggccgcgccuacaaccacgcccucuccgagcuccccgagacccucgagacccuccuccuccucacccuccucgccaccgucaccggcggcgucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccaggagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccgucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucucccucgucgagaacuggcucaacaacgacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucggcaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccucaaggagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11798 - RNA, 9876 nt, Artificial Sequence
  derived and/or modified CDS sequence (opt2) from DENV-2__GQ868621__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacauccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucaugacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcacacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11799 - RNA, 9876 nt, Artificial Sequence
  derived and/or modified CDS sequence (opt2) from DENV-2__FJ639704__SS-prME
uccgccggcaugaucaucaugcucauccccaccgucgucgccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaagaccaagaugcucuccaccgaguccuacaaccagaccuuccucaucgacggccccgagaccaccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacaucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11800 - RNA, 9876 nt, Artificial Sequence
  derived and/or modified CDS sequence (opt2) from DENV-2__GQ868622__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggcccgccagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcgacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaccuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggaccgccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgccaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11801 - RNA, 9876 nt, Artificial Sequence
  derived and/or modified CDS sequence (opt2) from DENV-2__FJ639705__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggcccgccagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcgacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccucucccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaccuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgccaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11802 - RNA, 9876 nt, Artificial Sequence
  derived and/or modified CDS sequence (opt2) from DENV-2__FJ639706__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucgcccuccucucccaguccaccauccccgagaccauccucgagcucaccgacgcccucgcccucggcaugaugguccucaagaucguccgcgacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaccuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgcaaggaccagcgcggcuccggccaggucggcaccuacggccucaacaccuucaccaacauggaggcccagcucauccgccagauggagggcgagggcgucuucaagaacauccagcaccucaccgccaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11803 - RNA, 9876 nt, Artificial Sequence
  derived and/or modified CDS sequence (opt2) from DENV-2__FJ639707__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacauccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccaccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucaugacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgccgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgccaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacucccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucgucggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11804 - RNA, 9876 nt, Artificial Sequence
  derived and/or modified CDS sequence (opt2) from DENV-2__FJ639708__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacauccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucaugacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11805 - RNA, 9876 nt, Artificial Sequence
  derived and/or modified CDS sequence (opt2) from DENV-2__FJ639709__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccagaccaccauccccgagaccauccucgagcucaccgacgcccucgcccucggcaugaugguccucaagaucguccgcgacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucuggaacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaccuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgccaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11806 - RNA, 9876 nt, Artificial Sequence
  derived and/or modified CDS sequence (opt2) from DENV-2__FJ639710__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcgccaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucauccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggccgccgcucccuccgcccccagcccaccgagcucaaguacuccuggaagaccuggggcaaggccaagaugcucuccaccgaguccuacaaccagaccuuccucaucgacggccccgagaccaccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggagcaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgaguggaucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacaccucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacgucaaggaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucaucuacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11807 - RNA, 9876 nt, Artificial Sequence
  derived and/or modified CDS sequence (opt2) from DENV-2__GQ868623__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggccucgcccucuuccucgaggagaugcuccgcacccgcgucggcaccaagcacgccauccuccucgucgccgucuccuucgucacccucaucaccggcaacauguccgucaaggaccucggccgcgucgucgucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcgacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaccaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaccuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaagcacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgccaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11808 - RNA, 9876 nt, Artificial Sequence
  derived and/or modified CDS sequence (opt2) from DENV-2__GQ868624__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcauggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaaggaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggccgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11809 - RNA, 9876 nt, Artificial Sequence
  derived and/or modified CDS sequence (opt2) from DENV-2__FJ639717__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggaguccaaggccuggcucguccaccgccagugguuccucgaccucccccuccccuggcuccccggcgccgacaagcagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaccgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcaccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcgacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacaccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccguccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaccuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgccaccgaggaggucgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11810 - RNA, 9876 nt, Artificial Sequence
  derived and/or modified CDS sequence (opt2) from DENV-2__FJ639718__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcauggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagaaggccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaaggaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacaaccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggccgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11811 - RNA, 9876 nt, Artificial Sequence
  derived and/or modified CDS sequence (opt2) from DENV-2__GQ868625__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcauggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccgcauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaaggaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggccgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11812 - RNA, 9876 nt, Artificial Sequence
  derived and/or modified CDS sequence (opt2) from DENV-2__KF955401__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcauggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgucgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuucaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaaggaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggccgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11813 - RNA, 9876 nt, Artificial Sequence
  derived and/or modified CDS sequence (opt2) from DENV-2__JF730047__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggaguccaaggccuggcucguccaccgccagugguuccucgaccucccccuccccuggcuccccggcgccgacaagcagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaccgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcaccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcgacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacaccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaccuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucauccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgccaccgaggaggucgccgucaagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11814 - RNA, 9876 nt, Artificial Sequence
  derived and/or modified CDS sequence (opt2) from DENV-2__JF730048__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggaguccaaggccuggcucguccaccgccagugguuccucgaccucccccuccccuggcuccccggcgccgacaagcagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaccgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcaccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugguccucaagaucguccgcgacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgacuccuucccccaguccaacgcccccaucaucgacgaggagcgcgagauccccgagcgcuccuggaacaccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaccuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgccaccgaggaggucgccgucaagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11815 - RNA, 9876 nt, Artificial Sequence
  derived and/or modified CDS sequence (opt2) from DENV-2__KF955402__SS-prME
uccgccggcaugaucaucaugcucauccccaccgucauggccuuccaccucaccacccgcaacggcgagccccacaugaucgucggcauccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccgucgcccccuccaugaccaugcgcugcaucggcaucuccaaccgcgucuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaaggaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagcacgccgucggcaacgacaccggcaagcacggcauggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacaagcaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgcuacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgucgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccaggaggagggcaucugcggcauccgcuccgucacccgccucgagaaccucauguggaagcagaucacccccgagcucaaccacauccucgccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgaguccuacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgccuucugcgacuccaagcucauguccgccgccaucaaggacaaccgcgccguccacgccgacaugggcuacuggaucgaguccgcccucaacgacaccuggaagaucgagaaggccuccuucaucgaggucaagaacugccacuggcccaagucccacacccucugguccaacggcguccucgaguccgagaugaucauccccaagaaccucgccggccccgucucccagcacaacuaccgccccggcuaccacacccagaucgccggccccuggcaccucggcaagcucgagauggacuucgacuucugcgacggcaccaccgucaucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcgucggcaccaagcacgccauccuccucgucgccgucuccuucgucacccucaucaccggcaacauguccuucaaggaccucggccgcgucgucgucauggucggcgccaccauggccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccguccucgagcucaccgacgcccucgcccucggcaugaugguccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaagaccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccaucuccauccccaucaccgccgccgccugguaccucugggaggucaagaagcagcgcgccggcguccucugggacguccccucccccccccccaugggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucaucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucaucgacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaagacccgcgacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaaggaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacguccuccccaccgucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcgucuucaagaacauccagcaccucaccgucaccgaggaggccgccguccagaacuggcucgcccgcgucggccgcgagcgccucucccgcauggccaucuccggcgacgacugcgucgucaagccccucgacgaccgcuucgccaacgcccucaccgcccucaacgacaugggcaagauccgcaaggacauccagcagugggagcccuccaagggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccaagcacgaguggaugaccaccgaggacaugcucaccgucuggaaccgcgucuggauccgcgagaaccccuggauggaggacaagacccccgucgaguccugggaggagauccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11816 - RNA, 9876 nt, Artificial Sequence
  derived and/or modified CDS sequence (opt2) from DENV-2__FJ898460__SS-prME
accgccggcgucaucgucaugcucauccccaccgccaucgccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucaacggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucuccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaaguccuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccaugcccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccguccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11817 - RNA, 9876 nt, Artificial Sequence
  derived and/or modified CDS sequence (opt2) from DENV-2__FJ882602__SS-prME
accgccggcaugaucaucaugcucauccccaccgccauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucgcccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagccccacaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgacgacggcugcugguacggcauggagauccgcccccucaaggagaaggaggagaaccucgucaacucccucgucaccgccggcuacggccagaucgacaacuucucccucggcguccucggcauggcccucuuccucgaggagaugcuccgcacccgcgucggcaccaagcacgccguccuccucgucgccgucuccuucaugacccucaucaccggcaacauguccuuccgcgaccucggccgcgucgucgucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugauccucaagaucguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagcgccgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaccggcgagacccucggcgagaaguggaagaaccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgacgucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacaugggcgcccagcucauccgccagauggagggcgaggaggucuucaagggcauccagcaccucaccgccaccgaggagaucgccguccagaacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgcccgccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11818 - RNA, 9876 nt, Artificial Sequence
  derived and/or modified CDS sequence (opt2) from DENV-2__GQ252676__SS-prME
accgccggcgucaucaucaugcucauccccaccgccauggccuuccaccucaccacccgcaacggcgagccccacaugaucgucuccaagcaggagaagggcaagucccuccucuucaagaccgaggagggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacauccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucuccaucaugaccggcgacaucaagggcaucaugcaggccggcaagcgcucccuccgcccccagcccaccgagcucaaguacuccuggaagaccuggggcaaggccaagaugcucuccaccgagccccacaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccguccuccucgucgccgucuccuucaugacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugauccucaagaucguccgcaacauggagaaguaccagcucgccgucaccaucauggccauccucugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaccggcgagacccucggcgagaaguggaagaaccgccucaacucccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucgcccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagaucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacaugggcgcccagcucauccgccagauggagggcgagggcgucuucaagggcauccagcaccucaccgccaccgaggaggucgccguccaggacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgcccgccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcuccgaggaguacaccgacuacaugcccuccaugaagcgcuuccgccgcgaggaggaggaggccggcguccucugguga

SEQ ID NO: 11819 - RNA, 9876 nt, Artificial Sequence
  derived and/or modified CDS sequence (opt2) from DENV-2__GQ252677__SS-prME
accgccggcgucaucaucaugcucauccccaccgccauggccuuccaccucaccacccgcaacggcgagccccacaugaucgucuccaagcaggagaagggcaagucccuccucuucaagaccgaggagggcgucaacaugugcacccucauggccauggaccucggcgagcucugcgaggacaccaucaccuacaacugcccccuccuccgccagaacgagcccgaggacaucgacugcuggugcaacuccaccuccaccugggucaccuacggcaccugcaccgccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccaccuacuuccagcgcguccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgccucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucgucaccccccacuccggcgaggagaacgccgucggcaacgacaccggcaagcacggcaaggagaucaaggucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacauccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucguccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucuccugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgucaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucuccaucaugaccggcgacaucaagggcaucaugcaggccggcaagcgcucccuccgcccccagcccaccgagcucaaguacuccuggaagaccuggggcaaggccaagaugcucuccaccgagccccacaaccagaccuuccucaucgacggccccgagaccgccgagugccccaacaccaaccgcgccuggaacucccucgaggucgaggacuacggcuucggcgucuucaccaccaacaucuggcucaagcucaaggagcgccaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcgucggcaccaagcacgccguccuccucgucgccgucuccuucaugacccucaucaccggcaacauguccuuccgcgaccucggccgcgucauggucauggucggcgccgccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccaccauccccgagaccauccucgagcucaccgacgcccucgcccucggcaugaugauccucaagaucguccgcaacauggagaaguaccagcucgccgucaccaucauggccauccucugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccaacaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacguccgcugggaggaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacguccgcaaggaccucaucuccuacggcggcggcuggaagcucgagggcgaguggaaggagggcgaggagguccagguccucgcccucgagcccggcaagaacccccgcgccguccagaccaagcccggccucuucaagaccaacaccggcaccaucggcgccgucucccucgacuucucccccggcaccuccggcucccccaucgucgacaagaagggcaaggucgucggccucuacggcaacggcgucgucacccgcuccggcaccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacaucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuaccgcgucgccgccgagggcaucaacuacgccgaccgccgcuggugcuucgacggcaucaagaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggacuucggccucggcuccaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaccggcgagacccucggcgagaaguggaagaaccgccucaacucccucggcaaguccgaguuccagaucuacaagcgcuccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccgucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucauccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcuccgcaagaagaagaccccccgcaugugcacccgcgaggaguucgcccgcaagguccgcuccaacgccgcccucggcgccaucuucaccgacgagaacaaguggaaguccgcccgcgaggccgucgaggacucccgcuucugggagcucgucgacaaggagcgcaaccuccaccucgagggcaagugcgagaccugcgucuacaacaugaugggcaagcgcgagaagaagaucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucacccucgaggaccucaagaacgaggagauggucaccaaccacauggagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacaugggcgcccagcucauccgccagauggagggcgagggcgucuucaagggcauccagcaccucaccgccaccgaggaggucgccguccaggacuggcucgcccgcgucggccgcgagcgccucucccgcauggccaucuccggcgacgacugcgucgucaagccccucgacgaccgcuucgccuccgcccucaccgcccucaacgacaugggcaagguccgcaaggacauccagcagugggagcccucccgcggcuggaacgacuggacccagguccccuucugcucccaccacuuccacgagcucaucaugaaggacggccgcguccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgcccgccacgaguggaugaccaccgaggacaugcucaccgucuggaaccgcgucuggauccaggagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcuccgaggaguacaccgacuacaugcccuccaugaagcgcuuccgccgcgaggaggaggaggccggcguccucugguga

SEQ ID NO: 11820 - RNA, 9876 nt, Artificial Sequence
  derived and/or modified CDS sequence (opt2) from DENV-2__FJ898438__SS-prME
accgucggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcuccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaacuucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacuccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgccuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11821 - RNA, 9876 nt, Artificial Sequence
  derived and/or modified CDS sequence (opt2) from DENV-2__GQ199893__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagaaggcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacaucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccaggucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccccccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11822 - RNA, 9876 nt, Artificial Sequence
  derived and/or modified CDS sequence (opt2) from DENV-2__GQ199894__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagaaggcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagcacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgccuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacaucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccaggucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccccccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11823 - RNA, 9876 nt, Artificial Sequence
  derived and/or modified CDS sequence (opt2) from DENV-2__FJ898439__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcuccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccggcaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccaggucgacaacuucucccucggcguccucggcauggcccucuuccucgaggagaugcuccgcacccgcaucggcaccaagcacgccauccuccucgucgccgccuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgagaccggcggcaaggccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggcuucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucgucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagcgcaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggaggucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11824 - RNA, 9876 nt, Artificial Sequence
  derived and/or modified CDS sequence (opt2) from DENV-2__GQ868588__SS-prME
accgccggcaugaucaucaugcucauccccaccgucauggccuuccaccucaccacccgcaacggcgagccccacaugaucgucucccgccaggagaagggcaagucccuccucuucaagaccaaggacggcaccaacaugugcacccucauggcccucgaccucggcgagcucugcgaggacaccaucaccuacaagugccccuuccucaagcagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccaucgcccccuccauggccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgacucccgcugccccacccagggcgagcccacccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccgucgucaucaccccccacuccggcgaggagcacgccgucggcaacgacaccggcaagcacggcaaggaggucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucgacugguuccgcaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucgucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucaccuccgagcucaaccacauccucuccgagaacgaggucaagcucaccaucaugaccggcgacaucaagggcaucaugcaggucggcaagcgcucccuccgcccccagcccaccgagcuccgcuacuccuggaagaccuggggcaaggccaagaugcucuccaccgagcuccacaaccagaccuuccucaucgacggccccgagaccgccgagugccccaacaccaaccgcgccuggaacucccucgaggucgaggacuacggcuucggcgucuucaccaccaacaucuggcuccgccuccgcgagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagauggucauccccaagaacuucgccggccccgucucccagcacaacaaccgccccggcuaccacacccagaccgccggccccuggcaccucggcaagcucgagauggacuucgacuucugcgagggcaccaccgucgucgucaccgaggagugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucuccucccucgucaccgccggccacggccagaucgacaacuucucccucggcauccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugaugaccaccaucggcaucguccuccucucccaguccuccauccccgagaccauccucgagcucaccgacgcccucgcccucggcaugaugguccucaagaugguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccaccgacgucaagugggacgaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacauccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuuccgcaccaacaccggcaccaucggcgccgucucccucgacuucucccccggcaccuccggcucccccaucgucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagaaguaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaagaccggcaacgacaucgccgccugccuccgcaagaacggcaagcgcgucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaacccccgcaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccuccgagggcaucaacuacgccgaccgccgcuggugcuucgacggcacccgcaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucaucaucgccauccucaccgucgucgccgccaccauggccaacgagaugggcuuccucgagaagaccaagaaggaccucggccucggccacaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccgucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucgucccccccgagaagugcgacacccuccucugcgacaucggcgaguccucccccaaccccaccgucgaggccggccgcacccuccgcguccucaaccucgucgagaacuggcucaacaacaacacccaguucugcgucaagguccucaaccccuacaugcccuccgucaucgagcgcauggagacccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgaggccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacaaccgcuucugggagcucgucgacaaggagcgcaaccuccaccucgagggcaagugcgagaccugcaucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucaccaucgaggaccucaagaacgaggagaugaucaccaaccacauggccggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccuccgaggagaucgccguccaggacuggcucguccgcgucggccgcgagcgccucucccgcauggccaucuccggcgacgacugcgucgucaagccccucgacgaccgcuucgcccgcgcccucaccgcccucaacgacaugggcaagguccgcaaggacauccagcagugggagcccucccgcggcuggaacgacuggacccagguccccuucugcucccaccacuuccacgagcucaucaugaaggacggccgcauccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccucccacgaguggaugaccaccgaggacaugcucaccgucuggaaccgcgucuggauccucgagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11825 - RNA, 9876 nt, Artificial Sequence
  derived and/or modified CDS sequence (opt2) from DENV-2__GQ868590__SS-prME
accgccggcaugaucaucaugcucauccccaccgucauggccuuccaccucaccacccgcaacggcgagccccacaugaucgucucccgccaggagaagggcaagucccuccucuucaagaccaaggacggcaccaacaugugcacccucauggccauggaccucggcgagcucugcgaggacaccaucaccuacaagugccccuuccucaagcagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacgcccagcgcaucgagaccuggauccuccgccaccccggcuucaccaucauggccgccauccucgccuacaccaucggcaccacccacuuccagcgcguccucaucuucauccuccucaccgccaucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgacucccgcugccccacccagggcgagcccacccucaacgaggagcaggacaagcgcuucgucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccgucgucaucaccccccacuccggcgaggagcacgccgucggcaacgacaccggcaagcacggcaaggaggucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucgacugguucaagaagggcuccuccaucggccagauguucgagaccaccaugcgcggcgccaagcgcauggccauccucggcgacaccgccugggacuucggcucccucggcggcauguucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcaucgucacccucuaccucggcgucaugguccaggccgacuccggcugcgucgucuccuggaagaacaaggagcucaagugcggcuccggcaucuucgucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaccaagggcaucaugcaggucggcaagcgcucccuccgcccccagcccaccgagcuccgcuacuccuggaagaccuggggcaaggccaagaugcuccccaccgagcuccacaaccagaccuuccucaucgacggccccgagaccgccgagugccccaacaccaaccgcgccuggaacucccucgaggucgaggacuacggcuucggcgucuucaccaccaacaucuggcuccgccuccgcgagaagcaggacgucuucugcgacuccaagcucauguccgccgccaucaaggacaaccgcgccguccacgccgacaugggcuacuggaucgaguccgcccucaacgacaccuggaagaucgagaaggccuccuucaucgaggucaaguccugccacuggcccaagucccacacccucugguccaacggcguccucgaguccgagauggucauccccaagaaccucgccggccccgucucccagcacaacaaccgccccggcuaccacacccagaccgccggccccuggcaccucggcaagcucgagauggacuucaacuucugcgagggcaccaccgucgucgucaccgaggagugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucuccucccucgucaccgccggccacggccagaucgacaacuucucccucggcauccucggcauggcccucuuccucgaggagaugcuccgcacccgcgucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuacaagguccgccccaccuucgccgccggccuccuccuccgcaagcucaccuccaaggagcucaugaugaccaccaucggcaucguccuccucucccaguccuccauccccgagaccauccucgagcucaccgacgcccucgcccucggcaugaugguccucaagaugguccgcaacauggagaaguaccagcucgccgucaccaucauggccauccucugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagaaggccaccgacgucaagugggacgaccaggccgagaucuccggcuccucccccauccucuccaucaccaucuccgaggacggcuccauguccaucaagaacgaggaggaggagcagacccucaccauccucauccgcaccggccuccucgucaucuccggccucuuccccgucuccauccccaucaccgccgccgccugguaccucugggaggucaagaagcagcgcgccggcguccucugggacguccccucccccccccccgucggcaaggccgagcucgaggacggcgccuaccgcaucaagcagaagggcauccucggcuacucccagaucggcgccggcgucuacaaggagggcaccuuccacaccauguggcacgucacccgcggcgccguccucaugcacaagggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggccucuuccgcaccaacaccggcaccaucggcgccgucucccucgacuucucccccggcaccuccggcucccccaucgucgacaagaagggcaaggucgucggccucuacggcaacggcgucgucacccgcuccggcgccuacgucuccgccaucgcccagaccgagaaguccaucgaggacaaccccgagaucgaggacgacaucuuccgcaagcgccgccucaccaucauggaccuccaccccggcgccggcaagaccaagaaguaccuccccgccaucguccgcgaggccaucaagcgcggccuccgcacccucauccucgcccccacccgcgucgucgccgccgagauggaggaggcccuccgcggccuccccauccgcuaccagacccccgccauccgcgccgagcacaccggccgcgagaucgucgaccucaugugccacgccaccuucaccaugcgccuccucucccccauccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaagaccggcaacgacaucgccgccugccuccgcaagaacggcaagcgcgucauccagcucucccgcaagaccuucgacuccgaguacgucaagacccgcaccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaacccccgcaacgagaacgaccaguacaucuacaugggcgagccccucgagaacgacgaggacugcgcccacuggaaggaggccaagaugcuccucgacaacaucaacacccccgagggcaucauccccuccauguucggccccgagcgcgagaaggucgacgccaucgacggcgaguaccgccuccgcggcgaggcccgcaagaccuucgucgagcucaugcgccgcggcgaccuccccgucuggcucgccuacaaggucgccuccgagggcaucaacuacgccgaccgccgcuggugcuucgacggcacccgcaacaaccagauccucgaggagaacgucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcgacgcccucgacaaccucgccguccuccacaccgccgaggccggcggcaaggccuacaaccacgcccucuccgagcuccccgagacccucgagacccuccuccuccucacccuccucgccaccgucaccggcggcaucuuccucuuccucauguccggccgcggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucaucaucgccauccucaccgucgucgccgccaccauggccaacgagaugggcuuccucgagaagaccaagaaggaccucggccucggccacaucgccacccagcagcccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucguccucugcgucacccagguccucaugaugcgcaccaccugggcccucugcgaggcccucacccucgccaccggccccgucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaaccucgucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaucccccccgagaagugcgacacccuccucugcgacaucggcgaguccucccccaaccccaccgucgaggccggccgcacccuccgcguccucaaccucgucgaguccuggcucaacaacaacacccaguucugcgucaagguccucaaccccuacaugcccuccgucaucgagcgcauggagacccuccagcgcaaguacggcggcgcccucguccgcaacccccucucccgcaacuccacccacgagauguacugggucuccaacgccuccggcaacgucgucuccuccgucaacaugaucucccgcaugcucaucaaccgcuucaccaugcgccacaagaaggccaccuacgagcccgacgucgaccucggcuccggcacccgcaacaucggcaucgaguccgagacccccaaccucgacaucaucggcaagcgcaucgagaagaucaagcaggagcacgaggccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacaaccgcuucugggagcucgucgacaaggagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccacaagcucggcuacauccuccgcgaggucuccaagaaggagggcggcgccauguacgccgacgacaccgccggcugggacacccgcaucaccaucgaggaccucaagaacgaggagaugaucaccaaccacauggccggcgagcacaagaagcucgccgaggccaucuucaagcucaccuaccagaacaaggucguccgcguccagcgccccacccccaucggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccuccgaggagaucgccguccaggacuggcucguccgcgucggccgcgagcgccucucccgcauggccaucuccggcgacgacugcgucgucaagccccucgacgaccgcuucgcccgcgcccucaccgcccucaacgacaugggcaagguccgcaaggacauccagcagugggagcccucccgcggcuggaacgacuggacccagguccccuucugcucccaccacuuccacgagcucaucaugaaggacggccgcacccucgucguccccugccgcaaccaggacgagcucaucggccgcgcccgcaucucccagggcgccggcuggucccuccgcgagaccgccugccucggcaaguccuacgcccagauguggucccucauguacuuccaccgccgcgaccuccgccucgccgccaacgccaucugcuccgccguccccucccacuggguccccaccucccgcaccaccugguccauccacgccucccacgaguggaugaccaccgaggacaugcucaccgucuggaaccgcgucuggauccucgagaaccccuggauggaggacaagacccccgucgaguccugggaggagauccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11826 - RNA, 9876 nt, Artificial Sequence
  derived and/or modified CDS sequence (opt2) from DENV-2__GQ868497__SS-prME
accgccuccgucaucgucaugcucauccccaccgucauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcuccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucaugcagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgccuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccgucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaaggacguccgcgaggucaagggccucaccaagggcggccccggccacgaggagcccauccccauguccaccuacggcuggaaccucguccgccuccaguccggcaucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcgcgagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 11827 - RNA, 9876 nt, Artificial Sequence
  derived and/or modified CDS sequence (opt2) from DENV-2__GU131959__SS-prME
accgccggcgucaucgucaugcucauccccaccgucauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcuccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacacccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgagaccuggaagauggagaaggccuccuucaucgaggucaaguccugcuacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgccuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaaggacguccgcgaggucaagggccucaccaagggcggccccggccacgaggagcccauccccauguccaccuacggcuggaaccucguccgccuccaguccggcaucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 11828 - RNA, 9876 nt, Artificial Sequence
  derived and/or modified CDS sequence (opt2) from DENV-2__GQ868515__SS-prME
accgccggcgucaucgucaugcucauccccaccgucauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccuggaucaccuacggcaccugcuccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccgcuacgagggcgacggcucccccugcaagauccccuucgagaucaccgacuccgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucauccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgccuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgaguccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaaggacguccgcgaggucaagggccucaccaagggcggccccggccacgaggagcccauccccauguccaccuacggcuggaaccucguccgccuccaguccggcaucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaagaacauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 11829 - RNA, 9876 nt, Artificial Sequence
  derived and/or modified CDS sequence (opt2) from DENV-2__GQ868516__SS-prME
accgccggcgucaucgucaugcucauccccaccgucauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccuggaucaccuacggcaccugcuccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucauccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgccuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgaguccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaaggacguccgcgaggucaagggccucaccaagggcggccccggccacgaggagcccauccccauguccaccuacggcuggaaccucguccgccuccaguccggcaucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaagaacauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 11830 - RNA, 9876 nt, Artificial Sequence
  derived and/or modified CDS sequence (opt2) from DENV-2__GU131975__SS-prME
accgccggcgucaucgucaugcucauccccaccgucauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccuggaucaccuacggcaccugcuccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucauccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgccuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgaguccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaaggacguccgcgaggucaagggccucaccaagggcggccccggccacgaggagcccauccccauguccaccuacggcuggaaccucguccgccuccaguccggcaucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcucccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaagaacauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 11831 - RNA, 9876 nt, Artificial Sequence
  derived and/or modified CDS sequence (opt2) from DENV-2__JN819422__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagaaggcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagacccagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacaucgaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcgucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccaggucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccccccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11832 - RNA, 9876 nt, Artificial Sequence
  derived and/or modified CDS sequence (opt2) from DENV-2__GU131955__SS-prME
accgccggcgucaucgucaugcucauccccaccgucauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcuccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgccuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaaggacguccgcgaggucaagggccucaccaagggcggccccggccacgaggagcccauccccauguccaccuacggcuggaaccucguccgccuccaguccggcaucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 11833 - RNA, 9876 nt, Artificial Sequence
  derived and/or modified CDS sequence (opt2) from DENV-2__KJ189311__SS-prME
accgccggcgucaucgucaugcucauccccaccgucauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccuggaucaccuacggcaccugcuccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucauccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgccuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgaguccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccucgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaaggacguccgcgaggucaagggccucaccaagggcggccccggccacgaggagcccauccccauguccaccuacggcuggaaccucguccgccuccaguccggcaucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggagacccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcucccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaagaacauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgcaaggaggaggaggaggccggcguccucugguga

SEQ ID NO: 11834 - RNA, 9876 nt, Artificial Sequence
  derived and/or modified CDS sequence (opt2) from DENV-2__KJ189370__SS-prME
accgccggcgucaucgucaugcucauccccaccgccauggccuuccaccucaccacccgcaacggcgagccccacaugaucgucucccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcucaaggagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaaggucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaaggccgaguacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuuccucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgaccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgaggucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucguccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11835 - RNA, 9876 nt, Artificial Sequence
  derived and/or modified CDS sequence (opt2) from DENV-2__EU482620__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacaccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11836 - RNA, 9876 nt, Artificial Sequence
  derived and/or modified CDS sequence (opt2) from DENV-2__FJ373300__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaccaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccguccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11837 - RNA, 9876 nt, Artificial Sequence
  derived and/or modified CDS sequence (opt2) from DENV-2__EU596495__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccggcaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11838 - RNA, 9876 nt, Artificial Sequence
  derived and/or modified CDS sequence (opt2) from DENV-2__EU596497__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaucaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaaguccuacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11839 - RNA, 9876 nt, Artificial Sequence
  derived and/or modified CDS sequence (opt2) from DENV-2__EU569695__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccgucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11840 - RNA, 9876 nt, Artificial Sequence
  derived and/or modified CDS sequence (opt2) from DENV-2__EU482623__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccuccuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacuccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaucgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11841 - RNA, 9876 nt, Artificial Sequence
  derived and/or modified CDS sequence (opt2) from DENV-2__EU569698__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgacuccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11842 - RNA, 9876 nt, Artificial Sequence
  derived and/or modified CDS sequence (opt2) from DENV-2__EU569699__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccaaguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgacaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccuccuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccgucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaucgaggagaucgccguccagaacuggcucgcccgcgucggccgcgagcgccucucccgcauggccaucuccggcgacgacugcgucaucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11843 - RNA, 9876 nt, Artificial Sequence
  derived and/or modified CDS sequence (opt2) from DENV-2__KF955366__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccucccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11844 - RNA, 9876 nt, Artificial Sequence
  derived and/or modified CDS sequence (opt2) from DENV-2__EU569700__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11845 - RNA, 9876 nt, Artificial Sequence
  derived and/or modified CDS sequence (opt2) from DENV-2__KF955369__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccaccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11846 - RNA, 9876 nt, Artificial Sequence
  derived and/or modified CDS sequence (opt2) from DENV-2__EU569702__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagcgcgccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacuccgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11847 - RNA, 9876 nt, Artificial Sequence
  derived and/or modified CDS sequence (opt2) from DENV-2__EU482624__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccaacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacauccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11848 - RNA, 9876 nt, Artificial Sequence
  derived and/or modified CDS sequence (opt2) from DENV-2__EU596500__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagauggucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaaguccaucggcaagaugacccucggcaugugcugcaucaucaccgccuccauccuccucuggcacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccucuucgccaucggcugcuacuaccaggucaaccccaucacccucaccgccgcccuccuccuccucgucgcccacaacgccaucaucggccagggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11849 - RNA, 9876 nt, Artificial Sequence
  derived and/or modified CDS sequence (opt2) from DENV-2__EU482626__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacauccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccacccagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11850 - RNA, 9876 nt, Artificial Sequence
  derived and/or modified CDS sequence (opt2) from DENV-2__EU482629__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuucaaggaccucggccgcgucauggucaugaugggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucaucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagauccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11851 - RNA, 9876 nt, Artificial Sequence
  derived and/or modified CDS sequence (opt2) from DENV-2__FJ390390__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccaaguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgacaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccuccuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccgucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11852 - RNA, 9876 nt, Artificial Sequence
  derived and/or modified CDS sequence (opt2) from DENV-2__FJ390391__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccaucuucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11853 - RNA, 9876 nt, Artificial Sequence
  derived and/or modified CDS sequence (opt2) from DENV-2__FJ882593__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccaggaguccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11854 - RNA, 9876 nt, Artificial Sequence
  derived and/or modified CDS sequence (opt2) from DENV-2__FJ182014__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugccccuuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaucaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11855 - RNA, 9876 nt, Artificial Sequence
  derived and/or modified CDS sequence (opt2) from DENV-2__FJ547090__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccaccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccucggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11856 - RNA, 9876 nt, Artificial Sequence
  derived and/or modified CDS sequence (opt2) from DENV-2__EU482630__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugccccuuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11857 - RNA, 9876 nt, Artificial Sequence
  derived and/or modified CDS sequence (opt2) from DENV-2__FJ882594__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaacauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgaggccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11858 - RNA, 9876 nt, Artificial Sequence
  derived and/or modified CDS sequence (opt2) from DENV-2__FJ205885__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcguccucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacaccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11859 - RNA, 9876 nt, Artificial Sequence
  derived and/or modified CDS sequence (opt2) from DENV-2__FJ744743__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccggcaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccucuggccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccgucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccacccuccuccgcuucgucgcccaguacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaucgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11860 - RNA, 9876 nt, Artificial Sequence
  derived and/or modified CDS sequence (opt2) from DENV-2__JN819424__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccuccuccaucgacaaccgcgccguccacgccgacaugggcuacuggauggaguccgcccccuccgacuccugcaagauggagaaggccuccuucaucgaggacaaguccugcuacuggcccaacucccagcaccucugguccaacggcguccucgaguccgagaugaucuuccccaagaacuucgccggccccgucucccagcacaucuaccgccccggcuaccacacccagaccgccggccccugcaaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgaggccaucgacggcgaguaccgccuccgcggcgaggcccgcaagaccuucgucgaccucaugcgccgcggcgaccuccccguccgccucgccuacaaggucgccgccgagggcaucaacuacgccgaccgcaaguggugcuucgacggcaucaagaacucccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11861 - RNA, 9876 nt, Artificial Sequence
  derived and/or modified CDS sequence (opt2) from DENV-2__FJ744741__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggcgcgucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11862 - RNA, 9876 nt, Artificial Sequence
  derived and/or modified CDS sequence (opt2) from DENV-2__FJ744703__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcaccgacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccccuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggccgcgccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11863 - RNA, 9876 nt, Artificial Sequence
  derived and/or modified CDS sequence (opt2) from DENV-2__FJ850067__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccacccucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaccaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgagacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagauccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11864 - RNA, 9876 nt, Artificial Sequence
  derived and/or modified CDS sequence (opt2) from DENV-2__FJ850060__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagauccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcgccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcauccgcaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggcaagcuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccccccacuggguccccaccucccgcaccaccugguccauccacgccaagcacgaguggaugaccaccgaggacaugcucgccgucuggaaccgcgucuggauccagggcaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11865 - RNA, 9876 nt, Artificial Sequence
  derived and/or modified CDS sequence (opt2) from DENV-2__FJ850061__SS-prME
accgccggcgucaucaucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgccaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaagcccaucaccuucaccgccgcccuccuccuccucgucgcccacuacgccaucaucggccccggccuccaggccaaggccccccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccccccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11866 - RNA, 9876 nt, Artificial Sequence
  derived and/or modified CDS sequence (opt2) from DENV-2__FJ744709__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccguccucgccuacaccaucggcaccacccacuuccagaaggcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcaucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacaccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggccgcaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11867 - RNA, 9876 nt, Artificial Sequence
  derived and/or modified CDS sequence (opt2) from DENV-2__FJ744708__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgccgagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggucaacaucuucuccggcuccuaccucgccggcgccggccuccacgucccccuccgcaagaacacccuccgcacccgccgcggcaccggcaacaccggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11868 - RNA, 9876 nt, Artificial Sequence
  derived and/or modified CDS sequence (opt2) from DENV-2__FJ810418__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucaagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucgucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagauggucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgucgaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11869 - RNA, 9876 nt, Artificial Sequence
  derived and/or modified CDS sequence (opt2) from DENV-2__FJ639835__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagauggucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaaguccaucggcaagaugacccucggcaugugcugcaucaucaccgccuccauccuccucuggcacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11870 - RNA, 9876 nt, Artificial Sequence
  derived and/or modified CDS sequence (opt2) from DENV-2__FJ850050__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcggcaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaguacaaccgcgccguccacgccgacaugggcuacuggaucgaguccgcccccugcgacuccugggagaugcagaaggccuccuucaucgaggucaucuccugccacuggcccaagucccucacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacaugcaggagcagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11871 - RNA, 9876 nt, Artificial Sequence
  derived and/or modified CDS sequence (opt2) from DENV-2__FJ639837__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagauggucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaaguccaucggcaagaugacccucggcaugugcugcaucaucaccgccuccauccuccucuggcacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgcccccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucgccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11872 - RNA, 9876 nt, Artificial Sequence
  derived and/or modified CDS sequence (opt2) from DENV-2__FJ744706__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccggcucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcggcaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11873 - RNA, 9876 nt, Artificial Sequence
  derived and/or modified CDS sequence (opt2) from DENV-2__FJ744707__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucgcccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11874 - RNA, 9876 nt, Artificial Sequence
  derived and/or modified CDS sequence (opt2) from DENV-2__FJ744704__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcauguucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaucugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccccccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11875 - RNA, 9876 nt, Artificial Sequence
  derived and/or modified CDS sequence (opt2) from DENV-2__FJ744745__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccucaagauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccacccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccccccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11876 - RNA, 9876 nt, Artificial Sequence
  derived and/or modified CDS sequence (opt2) from DENV-2__FJ744705__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacgacucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcaucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgucgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccccccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11877 - RNA, 9876 nt, Artificial Sequence
  derived and/or modified CDS sequence (opt2) from DENV-2__FJ744744__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccucaagauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgucggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgucgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgagaacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccuccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccccccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11878 - RNA, 9876 nt, Artificial Sequence
  derived and/or modified CDS sequence (opt2) from DENV-2__GQ868646__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccaaguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgacaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccuccuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccgucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaaggagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11879 - RNA, 9876 nt, Artificial Sequence
  derived and/or modified CDS sequence (opt2) from DENV-2__FJ906961__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagccccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggaggucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11880 - RNA, 9876 nt, Artificial Sequence
  derived and/or modified CDS sequence (opt2) from DENV-2__FJ906962__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgagaucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaacauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacaucgaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11881 - RNA, 9876 nt, Artificial Sequence
  derived and/or modified CDS sequence (opt2) from DENV-2__FJ850053__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagccccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11882 - RNA, 9876 nt, Artificial Sequence
  derived and/or modified CDS sequence (opt2) from DENV-2__JN819420__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagcgcgccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacuccgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaugggcugcuacucccaguucaagcccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11883 - RNA, 9876 nt, Artificial Sequence
  derived and/or modified CDS sequence (opt2) from DENV-2__FJ850118__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggcuacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccccccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11884 - RNA, 9876 nt, Artificial Sequence
  derived and/or modified CDS sequence (opt2) from DENV-2__JN819416__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccccccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11885 - RNA, 9876 nt, Artificial Sequence
  derived and/or modified CDS sequence (opt2) from DENV-2__FJ850119__SS-prME
accgccggcgucaucgucaugcucauccccaccgccauggccuuccaccucaccacccgcaacggcgagccccacaugaucgucggccgccaggagaagggcaagucccuccucuucaagaccgaggacggcaucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccuccgaggagaccgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccccccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11886 - RNA, 9876 nt, Artificial Sequence
  derived and/or modified CDS sequence (opt2) from DENV-2__FJ850064__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgccaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagguccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccccccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11887 - RNA, 9876 nt, Artificial Sequence
  derived and/or modified CDS sequence (opt2) from DENV-2__FJ850065__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaccgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggaggacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaagcacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccccccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11888 - RNA, 9876 nt, Artificial Sequence
  derived and/or modified CDS sequence (opt2) from DENV-2__FJ873808__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagauccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcgccauccucgccgccgucuccgucuccccccuccuccucaccuccuccaagcagaaggccgacuggaucccccucgcccucaccaucaagggccucaaccccaccgccaucuuccucaccacccucucccgcaccuccaagaagcgcuccuggccccucaacgaggccgucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcauccgcaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggcaagcuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccccccacuggguccccaccucccgcaccaccugguccauccacgccaagcacgaguggaugaccaccgaggacaugcucgccgucuggaaccgcgucuggauccagggcaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11889 - RNA, 9876 nt, Artificial Sequence
  derived and/or modified CDS sequence (opt2) from DENV-2__FJ850120__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccgucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccaagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaagaacaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcuccaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgagaacgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacucccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11890 - RNA, 9876 nt, Artificial Sequence
  derived and/or modified CDS sequence (opt2) from DENV-2__FJ850121__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgucacccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccccccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11891 - RNA, 9876 nt, Artificial Sequence
  derived and/or modified CDS sequence (opt2) from DENV-2__GQ199897__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucgucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccccccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11892 - RNA, 9876 nt, Artificial Sequence
  derived and/or modified CDS sequence (opt2) from DENV-2__GQ199895__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggaggacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccccccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11893 - RNA, 9876 nt, Artificial Sequence
  derived and/or modified CDS sequence (opt2) from DENV-2__FJ898478__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11894 - RNA, 9876 nt, Artificial Sequence
  derived and/or modified CDS sequence (opt2) from DENV-2__GQ199869__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacauccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11895 - RNA, 9876 nt, Artificial Sequence
  derived and/or modified CDS sequence (opt2) from DENV-2__JX079688__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucuggcacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaucgaggaguacaccgacuacaugcccuccaugaagcgcuuccgccgcgaggaggaggaggccggcguccucugguga

SEQ ID NO: 11896 - RNA, 9876 nt, Artificial Sequence
  derived and/or modified CDS sequence (opt2) from DENV-2__JF357906__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccguccucgccuacaccaucggcaccacccacuuccagaaggcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcaucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacaccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggccgcaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguacauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11897 - RNA, 9873 nt, Artificial Sequence
  derived and/or modified CDS sequence (opt2) from DENV-2__HQ705624__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccaaguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagguccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccaucaagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgacaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccuccuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccgucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuuccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11898 - RNA, 9876 nt, Artificial Sequence
  derived and/or modified CDS sequence (opt2) from DENV-2__HQ705625__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaugaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaccaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11899 - RNA, 9876 nt, Artificial Sequence
  derived and/or modified CDS sequence (opt2) from DENV-2__JF730052__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaugaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaccaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaccaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11900 - RNA, 9876 nt, Artificial Sequence
  derived and/or modified CDS sequence (opt2) from DENV-2__EU482748__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggagaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaagaccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgucguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11901 - RNA, 9876 nt, Artificial Sequence
  derived and/or modified CDS sequence (opt2) from DENV-2__EU482749__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagaccaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucuccgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagauccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11902 - RNA, 9876 nt, Artificial Sequence
  derived and/or modified CDS sequence (opt2) from DENV-2__EU482751__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11903 - RNA, 9876 nt, Artificial Sequence
  derived and/or modified CDS sequence (opt2) from DENV-2__GQ868604__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccgcggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaacauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucaccaagaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11904 - RNA, 9876 nt, Artificial Sequence
  derived and/or modified CDS sequence (opt2) from DENV-2__EU482752__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaacauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11905 - RNA, 9876 nt, Artificial Sequence
  derived and/or modified CDS sequence (opt2) from DENV-2__EU482753__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcuccaugaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11906 - RNA, 9876 nt, Artificial Sequence
  derived and/or modified CDS sequence (opt2) from DENV-2__EU482680__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaagaucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaccggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagaagcccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11907 - RNA, 9876 nt, Artificial Sequence
  derived and/or modified CDS sequence (opt2) from DENV-2__EU482754__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacauccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11908 - RNA, 9876 nt, Artificial Sequence
  derived and/or modified CDS sequence (opt2) from DENV-2__FJ478455__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccgucguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgucgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgacuucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgccaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaucuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccaggccgccaucaaccagguccgcucccucaucggcaacgaggaguacaccgacuacaugcccuccaugaagcgcuuccgccgcgaggaggaggaggccggcguccucugguga

SEQ ID NO: 11909 - RNA, 9876 nt, Artificial Sequence
  derived and/or modified CDS sequence (opt2) from DENV-2__EU482756__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaaguacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11910 - RNA, 9876 nt, Artificial Sequence
  derived and/or modified CDS sequence (opt2) from DENV-2__EU482757__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacaucaagggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagacccccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccuccacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucuccaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgucguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11911 - RNA, 9876 nt, Artificial Sequence
  derived and/or modified CDS sequence (opt2) from DENV-2__FJ906956__SS-prME
accgccggcgucaucgucaugcucauccccaccgccauggccuuccaccucaccacccgcaacggcgagccccacaugaucgucggcaagcaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccggcaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagauggucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagcgcgucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaaccacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11912 - RNA, 9876 nt, Artificial Sequence
  derived and/or modified CDS sequence (opt2) from DENV-2__EU482759__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcggcgccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11913 - RNA, 9876 nt, Artificial Sequence
  derived and/or modified CDS sequence (opt2) from DENV-2__EU482760__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcgccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugccacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagauccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga

SEQ ID NO: 11914 - RNA, 9876 nt, Artificial Sequence
  derived and/or modified CDS sequence (opt2) from DENV-2__EU482762__SS-prME
accgccggcgucaucgucaugcucauccccaccgccauggccuuccaccucaccacccgcaacggcgagccccacaugaucgucggccgccaggagaagggcaagucccuccucuucaagaccgaggacggcgucaacaugugcacccucauggccaucgaccucggcgagcucugcgaggacaccaucaccuacaagugcccccuccuccgccagaacgagcccgaggacaucgacugcuggugcaacuccaccuccaccugggucaccuacggcaccugcaccaccaccggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaucauggccgccauccucgccuacaccaucggcaccacccacuuccagcgcgcccucaucuucauccuccucaccgccgucgcccccuccaugaccaugcgcugcaucggcaucuccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucaucugcaagcacuccauggucgaccgcggcuggggcaacggcugcggccucuucggcaagggcggcaucgucaccugcgccauguucaccugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggaggacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaagaucgucaaggagaucgccgagacccagcacggcaccaucgucauccgcguccaguacgagggcgacggcucccccugcaagauccccuucgagaucaccgaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucucccucguccucgucggcgucgucacccucuaccucggcgccaugguccaggccgacuccggcugcgucgucuccuggaagaacaaggagcucaagugcggcuccggcaucuucaucaccgacaacguccacaccuggaccgagcaguacaaguuccagcccgagucccccuccaagcucgccuccgccauccagaaggcccacgaggagggcaucugcggcauccgcuccgucacccgccucgagaaccucauguggaagcagaucacccccgagcucaaccacauccucuccgagaacgaggucaagcucaccaucaugaccggcgacauccgcggcaucaugcaggccggcaagcgcucccuccgcccccagcccaccgagcucaaguacuccuggaagaccuggggcaaggccaagaugcucuccaccgagucccacaaccagaccuuccucaucgacggccccgagaccgccgagugccccaacaccaaccgcgccuggaacucccucgaggucgaggacuacggcuucggcgucuucaccaccaacaucuggcucaagcuccgcgagaagcaggacgucuucugcgacuccaagcucauguccgccgccaucaaggacaaccgcgccguccacgccgacaugggcuacuggaucgaguccgcccucaacgacaccuggaagauggagaaggccuccuucaucgaggucaaguccugcuacuggcccaagucccacacccucugguccaacggcguccucgaguccgagaugaucauccccaagaacuucgccggccccgucucccagcacaacuaccgccccggcuaccacacccagaccgccggccccuggcaccucggcaagcucgagauggacuucgaccucugcgagggcaccaccgucgucgucaccgaggacugcggcaaccgcggccccucccuccgcaccaccaccgccuccggcaagcucaucaccgaguggugcugccgcuccugcacccuccccccccuccgcuaccgcggcgaggacggcugcugguacggcauggagauccgcccccucaaggagaaggaggagaaccucgucaacucccucgucaccgccggccacggccagaucgacaacuucucccucggcguccucggcauggcccucuuccucgaggagaugcuccgcacccgcaucggcaccaagcacgccauccuccucgucgccgucuccuucgucacccucaucaccggcaacauguccuuccgcgaccucggccgcgucauggucauggucggcgccaccaugaccgacgacaucggcaugggcgucaccuaccucgcccuccucgccgccuucaagguccgccccaccuucgccgccggccuccuccuccgcaagcucaccuccaaggagcucaugauggccaccaucggcaucgcccuccucucccaguccaccauccccgagaccauccucgagcucaccgacgcccucgcccucggcaugaugguccucaagaucguccgcaacauggagaaguaccagcucgccgucaccaucauggccaucuccugcguccccaacgccgucauccuccagaacgccuggaaggucuccugcaccauccucgccgccgucuccgucuccccccuccuccucaccuccucccagcagaaggccgacuggaucccccucgcccucaccaucaagggccucaaccccaccgccaucuuccucaccacccucucccgcaccuccaagaagcgcuccuggccccucaacgaggccaucauggccgucggcauggucuccauccucgccuccucccuccucaagaacgacauccccaugaccggcccccucgucgccggcggccuccucaccgucugcuacguccucaccggccgcuccgccgaccucgagcucgagcgcgccgccgacgucaagugggaggaccaggccgagaucuccggcuccucccccauccucuccaucaccaucuccgaggacggcuccauguccaucaagaacgaggaggaggagcagacccucaccauccucauccgcaccggccuccucgucaucuccggcgucuuccccgucuccauccccaucaccgccgccgccugguaccucugggaggucaagaagcagcgcgccggcguccucugggacguccccucccccccccccgucgagaaggccgagcucgaggacggcgccuaccgcaucaagcagcgcggcauccucggcuacucccagaucggcgccggcgucuacaaggagggcaccuuccacaccauguggcacgucacccgcggcgccguccucaugcaccgcggcaagcgcaucgagcccuccugggccgacgucaagaaggaccucaucuccuacggcggcggcuggaagcucgagggcgaguggaaggagggcgaggagguccagguccucgcccucgagcccggcaagaacccccgcgccguccagaccaagcccggcaucuucaagaccaacaccggcaccaucggcgccgucucccucgacuucucccccggcaccuccggcucccccaucgucgaccgcaagggcaaggucgucggccucuacggcaacggcgucgucacccgcuccggcgccuacgucuccgccaucgcccagaccgagaaguccaucgaggacaaccccgagaucgaggacgacaucuuccgcaagaagcgccucaccaucauggaccuccaccccggcgccggcaagaccaagcgcuaccuccccgccaucguccgcgaggccaucaagcgcggccuccgcacccucauccucgcccccacccgcgucgucgccgccgagauggaggaggcccuccgcggccuccccauccgcuaccagaccaccgccaucaagaccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucgagaugggcgaggccgccggcaucuucaugaccgccaccccccccggcucccgcgaccccuucccccaguccaacgcccccaucauggacgaggagcgcgagauccccgagcgcuccuggaacuccggccacgagugggucaccgacuucaagggcaagaccgucugguucguccccuccaucaaggccggcaacgacaucgccgccugccuccgcaagaacggcaagaaggucauccagcucucccgcaagaccuucgacuccgaguacgucaagacccgcgccaacgacugggacuucgucgucaccaccgacaucuccgagaugggcgccaacuucaaggccgagcgcgucaucgacccccgccgcugcaugaagcccgucauccucaccgacggcgaggagcgcgucauccucgccggccccaugcccgucacccacuccuccgccgcccagcgccgcggccgcaucggccgcaaccccaagaacgagaacgaccaguacaucuacaugggcgagccccucgagaacgacgaggacugcgcccacuggaaggaggccaagaugcuccucgacaacaucaacacccccgagggcaucauccccuccauguucgagcccgagcgcgagaaggucgacgccaucgacggcgaguaccgccuccgcggcgaggcccgcaagaccuucgucgaccucaugcgccgcggcgaccuccccgucuggcucgccuacaaggucgccgccgagggcaucaacuacgccgaccgcaaguggugcuucgacggcaucaagaacaaccagauccucgaggagaacauggaggucgagaucuggaccaaggagggcgagcgcaagaagcucaagccccgcuggcucgacgcccgcaucuacuccgacccccucgcccucaaggaguucaaggaguucgccgccggccgcaagucccucacccucaaccucaucaccgagaugggccgccuccccaccuucaugacccagaaggcccgcaacgcccucgacaaccucgccguccuccacaccgccgaggccggcggccgcgccuacaaccacgcccucuccgagcuccccgagacccucgagacccuccuccuccucacccuccucgccaccgucaccggcggcaucuuccucuuccucauguccggcaagggcaucggcaagaugacccucggcaugugcugcaucaucaccgccuccauccuccucugguacgcccagauccagccccacuggaucgccgccuccaucauccucgaguucuuccucaucguccuccucauccccgagcccgagaagcagcgcaccccccaggacaaccagcucaccuacgucgucaucgccauccucaccgucgucgccgccaccauggccaacgagaugggcuuccucgagaagaccaagaaggaccucggccucggcuccaucaccacccaggaguccgaguccaacauccucgacaucgaccuccgccccgccuccgccuggacccucuacgccgucgccaccaccuucgucacccccaugcuccgccacuccaucgagaacuccuccgucaacgucucccucaccgccaucgccaaccaggccaccguccucaugggccucggcaagggcuggccccucuccaagauggacaucggcgucccccuccucgccaucggcugcuacucccaggucaaccccaucacccucaccgccgcccuccuccuccucgucgcccacuacgccaucaucggccccggccuccaggccaaggccacccgcgaggcccagaagcgcgccgccgccggcaucaugaagaaccccaccgucgacggcaucaccgucaucgaccucgagcccauccccuacgaccccaaguucgagaagcagcucggccaggucaugcuccucauccucugcgucacccagguccucaugaugcgcaccaccugggcccucugcgaggcccucacccucgccaccggccccaucuccacccucugggagggcaaccccggccgcuucuggaacaccaccaucgccgucuccauggccaacaucuuccgcggcuccuaccucgccggcgccggccuccucuucuccaucaugaagaacaccaccaacacccgccgcggcaccggcaacaucggcgagacccucggcgagaaguggaagucccgccucaacgcccucggcaaguccgaguuccagaucuacaagaaguccggcauccaggaggucgaccgcacccucgccaaggagggcaucaagcgcggcgagaccgaccaccacgccgucucccgcggcuccgccaagcuccgcugguucgucgagcgcaacauggucacccccgagggcaaggucgucgaccucggcugcggccgcggcggcugguccuacuacugcggcggccucaagaacguccgcgaggucaagggccucaccaagggcggccccggccacgaggagcccauccccauguccaccuacggcuggaaccucguccgccuccaguccggcgucgacgucuucuucaccccccccgagaagugcgacacccuccucugcgacaucggcgaguccucccccaaccccaccaucgaggccggccgcacccuccgcguccucaaccucgucgagaacuggcucaacaacaacacccaguucugcaucaagguccucaaccccuacaugcccuccgucaucgagaagauggaggcccuccagcgcaaguacggcggcgcccucguccgcaacccccucucccgcaacuccacccacgagauguacugggucuccaacgccaccggcaacaucgucuccuccgucaacaugaucucccgcaugcucaucaaccgcuucaccaugaagcacaagaaggccaccuacgagcccgacgucgaccucggcuccggcacccgcaacaucggcaucgaguccgagauccccaaccucgacaucaucggcaagcgcaucgagaagaucaagcaggagcacgagaccuccuggcacuacgaccaggaccaccccuacaagaccugggccuaccacggcuccuacgagaccaagcagaccggcuccgccuccuccauggucaacggcgucguccgccuccucaccaagcccugggacgucguccccauggucacccagauggccaugaccgacaccacccccuucggccagcagcgcgucuucaaggagaaggucgacacccgcacccaggagcccaaggagggcaccaagaagcucaugaagaucaccgccgaguggcucuggaaggagcucggcaagaagaagaccccccgcaugugcacccgcgaggaguucacccgcaagguccgcuccaacgccgcccucggcgccaucuucaccgacgagaacaaguggaaguccgcccgcgaggccgucgaggacggccgcuucugggagcucgucgaccgcgagcgcaaccuccaccucgagggcaagugcgagaccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcggcaacucccucuccggcgucgagggcgagggccuccaccgccucggcuacauccuccgcgacgucggcaagaaggagggcggcgccauguacgccgacgacaccgccggcugggacacccgcaucacccucgaggaccucaagaacgaggagauggucaccaaccacaugaagggcgagcacaagaagcucgccgaggccaucuucaagcucaccuaccagaacaaggucguccgcguccagcgccccaccccccgcggcaccgucauggacaucaucucccgccgcgaccagcgcggcuccggccaggucggcaccuacggccucaacaccuucaccaacauggaggcccagcucauccgccagauggagggcgagggcaucuucaaguccauccagcaccucaccgccaccgaggagaucgccguccagaacuggcucgcccgcgucggccgcgagcgccucucccgcauggccaucuccggcgacgacugcgucgucaagcccaucgacgaccgcuucgccuccgcccucaccgcccucaacgacaugggcaagguccgcaaggacauccagcagugggagcccucccgcggcuggaacgacuggacccagguccccuucugcucccaccacuuccacgagcucgucaugaaggacggccgcguccucgucguccccugccgcaaccaggacgagcucaucggccgcgcccgcaucucccagggcgccggcuggucccucaaggagaccgccugccucggcaaguccuacgcccagauguggacccucauguacuuccaccgccgcgaccuccgccucgccgccaacgccaucugcuccgccguccccucccacuggguccccaccucccgcaccaccugguccauccacgccaagcacgaguggaugaccaccgaggacaugcucgccgucuggaaccgcgucuggauccaggagaaccccuggauggaggacaagacccccgucgaguccugggaggagguccccuaccucggcaagcgcgaggaccaguggugcggcucccucaucggccucaccucccgcgccaccugggccaagaacauccagaccgccaucaaccagguccgcucccucaucggcaacgaggaguacaccgacuacaugcccuccaugaagcgcuuccgccgcgaggaggaggaggccggcguccucugguga
